United States Patent
Christensen et al.

(10) Patent No.: US 10,604,766 B2
(45) Date of Patent: Mar. 31, 2020

(54) DROUGHT AND HEAT TOLERANCE IN PLANTS

(71) Applicant: Ceres, Inc., Thousand Oaks, CA (US)

(72) Inventors: Cory Christensen, Shorewood, OR (US); Wuyi Wang, Newbury Park, CA (US); Dennis Yang, Ballwin, MO (US)

(73) Assignee: CERES, INC., Thousand Oaks, CA (US)

( * ) Notice: Subject to any disclaimer, the term of this patent is extended or adjusted under 35 U.S.C. 154(b) by 0 days.

(21) Appl. No.: 13/785,345

(22) Filed: Mar. 5, 2013

(65) Prior Publication Data

US 2013/0174298 A1 Jul. 4, 2013

Related U.S. Application Data

(60) Division of application No. 12/856,204, filed on Aug. 13, 2010, now abandoned, which is a continuation of application No. PCT/US2009/034068, filed on Feb. 13, 2009.

(60) Provisional application No. 61/029,048, filed on Feb. 15, 2008.

(51) Int. Cl.
   *C12N 15/82* (2006.01)

(52) U.S. Cl.
   CPC ................. *C12N 15/8273* (2013.01)

(58) Field of Classification Search
   None
   See application file for complete search history.

(56) References Cited

U.S. PATENT DOCUMENTS

| 5,538,880 | A | 7/1996 | Lundquist et al. |
| 5,766,847 | A | 6/1998 | Jackle et al. |
| 5,878,215 | A | 3/1999 | Kling et al. |
| 6,013,863 | A | 1/2000 | Lundquist et al. |
| 6,455,253 | B1 | 9/2002 | Patten et al. |
| 6,906,244 | B2 | 6/2005 | Fischer et al. |
| 7,173,121 | B2 | 2/2007 | Fang |
| 7,179,904 | B2 | 2/2007 | Kwok |
| 7,214,789 | B2 | 5/2007 | Pennell |
| 7,312,376 | B2 | 12/2007 | Apuya et al. |

(Continued)

FOREIGN PATENT DOCUMENTS

| EP | 0 534 858 | 3/1993 |
| EP | 1 033 405 | 9/2000 |

(Continued)

OTHER PUBLICATIONS

Vij et al. Genome wide analysis of the stress associated protein (SAP) gene family containing A20/AN1 zinc-finger(s) in rice and their phylogenetic relationship with *Arabidopsis*. Molecular Genetics and Genomics. 2006. 276: 565-575.*

(Continued)

*Primary Examiner* — Ashley K Buran
(74) *Attorney, Agent, or Firm* — Dentons US LLP

(57) ABSTRACT

Methods and materials for modulating heat and/or drought tolerance in plants are disclosed. For example, nucleic acids encoding heat and/or drought-tolerance polypeptides are disclosed as well as methods for using such nucleic acids to transform plant cells. Also disclosed are plants having increased heat and/or drought tolerance and plant products produced from plants having increased heat and/or drought tolerance.

13 Claims, 30 Drawing Sheets

Specification includes a Sequence Listing.

```
SEQ-ID-NO-1201   MAQRDKK--EE PTELRAPE-H T------LCAN NCGFPGNPAT QNLCQSCFSA  43
SEQ-ID-NO-1207   MAQRDKKVEE PTELRAPE-L T------LCAN SCGFPGNPAT NNLCQACFQA  44
SEQ-ID-NO-1195   MAQRTEK--E ETEFKVPETL T------LCVN NCGVTGNPAT NNMCQKCFSA  43
SEQ-ID-NO-749    MAQRTEK--E ETEFKVLETL TTTTTTLCTN NCGVTANPAT NNMCQKCFNA  48

SEQ-ID-NO-1201   ATASMSSSPT S--SSSSTA PAPA------ PPQPRPAPAE LASPADAAVA  86
SEQ-ID-NO-1207   ATASSASASV SPPSPSSSLS PSPAVFKFDE QQHARPSATA -VFADRPAEQ  93
SEQ-ID-NO-1195   TTAATSSSSS S--SSTNNTA TSATD------ DKSSRSTPTR -SQDNRSDSA  85
SEQ-ID-NO-749    SLVSAAAGVV E----SGSFL ---------- KRSARSVNLR -SSPAKVVLR  83

SEQ-ID-NO-1201   APAPEAAKAP ART------- ---------- -SANRCSSCR KRVGLTGFRC 118
SEQ-ID-NO-1207   PPAPASARPI RTTS------ ------TSSS SSVNRCQSCR KRVGLTGFRC 131
SEQ-ID-NO-1195   PPTTAATTAT ATTNSPMTAS NRSGYDTAEK KSVNRCSGCR KRVGLTGFRC 135
SEQ-ID-NO-749    PREI DAMKKR DQQ------- ---------- -IVNRCSGCR KKVGLTGFRC 115

SEQ-ID-NO-1201   RCGELFCGAH RYSDRHQCSY DYKQAARDAI ARENPVVRAA KIVRF  163
SEQ-ID-NO-1207   RCGELFCGAH RYSDRHDCQF DYKAVGRDAI ARENPVVRAA KIVRF  176
SEQ-ID-NO-1195   RCGELFCSDH RYSDRHDCSY DYKAAGREAI ARENPVVKAA KIIRV  180
SEQ-ID-NO-749    RCGELFCSEH RYSDRHDCSY DYKTAGREAI ARENPVVKAA KMVKV  160
```

(56) References Cited

U.S. PATENT DOCUMENTS

| | | |
|---|---|---|
| 7,378,571 B2 | 5/2008 | Apuya |
| 7,385,105 B2 | 6/2008 | Medrano et al. |
| 7,389,805 B2 | 6/2008 | Kakutani et al. |
| 7,402,667 B2 | 7/2008 | Cook et al. |
| 7,429,692 B2 | 9/2008 | Dang |
| 7,598,367 B2 | 10/2009 | Cook et al. |
| 7,838,650 B2 | 11/2010 | Pennell et al. |
| 7,851,608 B2 | 12/2010 | Cook et al. |
| 8,232,380 B2 | 7/2012 | Kwok et al. |
| 8,278,434 B2 | 10/2012 | Cook et al. |
| 2003/0009784 A1 | 1/2003 | Lebel et al. |
| 2005/0032221 A1 | 2/2005 | Chang et al. |
| 2005/0086718 A1 | 4/2005 | Heard et al. |
| 2006/0015970 A1 | 1/2006 | Pennell et al. |
| 2006/0021083 A1 | 1/2006 | Cook et al. |
| 2006/0041952 A1 | 2/2006 | Cook |
| 2006/0260004 A1 | 11/2006 | Fang et al. |
| 2007/0006335 A1 | 1/2007 | Cook et al. |
| 2007/0042387 A1 | 2/2007 | Pennell et al. |
| 2007/0056058 A1 | 3/2007 | Olivier et al. |
| 2007/0056688 A1 | 3/2007 | Kim et al. |
| 2007/0136839 A1 | 6/2007 | Cook et al. |
| 2007/0214517 A1 | 9/2007 | Alexandrov et al. |
| 2008/0235823 A1 | 9/2008 | Medrano et al. |
| 2009/0106866 A1 | 4/2009 | Lu et al. |
| 2009/0181851 A1 | 7/2009 | Cook et al. |
| 2010/0037346 A1 | 2/2010 | Cook et al. |
| 2010/0223692 A1* | 9/2010 | Shirley ............... C07K 14/415 800/278 |
| 2010/0269222 A1 | 10/2010 | Medrano et al. |
| 2011/0016587 A1 | 1/2011 | Cook et al. |
| 2011/0023193 A1 | 1/2011 | Christensen et al. |
| 2011/0041219 A1 | 2/2011 | Cook et al. |
| 2011/0167514 A1* | 7/2011 | Brover et al. .............. 800/278 |
| 2011/0252501 A1* | 10/2011 | Abad ............... C12N 15/8261 800/275 |
| 2013/0031668 A1* | 1/2013 | Brover et al. .............. 800/282 |
| 2013/0117881 A1 | 5/2013 | Cook et al. |
| 2013/0117886 A1* | 5/2013 | Troukhan et al. ........... 800/285 |

FOREIGN PATENT DOCUMENTS

| | | | |
|---|---|---|---|
| EP | 1586645 A2 * | 10/2005 | ............ C12N 15/29 |
| WO | WO 05/002326 | 1/2005 | |
| WO | WO 05/011105 | 2/2005 | |
| WO | WO 05/023639 | 3/2005 | |
| WO | WO 05/034343 | 4/2005 | |
| WO | WO 2005/098007 | 10/2005 | |
| WO | WO 2006/005023 | 1/2006 | |
| WO | WO 2006/034479 | 3/2006 | |
| WO | WO 06/038236 | 4/2006 | |
| WO | WO 06/040572 | 4/2006 | |
| WO | WO 2006/036864 | 4/2006 | |
| WO | WO 2006/066193 | 6/2006 | |
| WO | WO 2007/044988 | 4/2007 | |
| WO | WO 07/049275 | 5/2007 | |
| WO | WO 2007/055826 | 5/2007 | |
| WO | WO 2007/127501 | 11/2007 | |
| WO | WO 2007/120989 | 7/2009 | |

OTHER PUBLICATIONS

Mukhopadhyay et al. Overexpression of a zinc-finger protein gene from rice confers tolerance to cold, dehydration, and salt stress in transgenic tobacco. PNAS. 2004. 101(16): 6309-6314.*
GenBank Accession No. Q9LHJ8. Zinc finger A20 and AN1 domain-containing stress associated protein 5 (AtSAP5). Published Jan. 9, 2007. pp. 1-3.*
U.S. Appl. No. 60/505,689, filed Sep. 23, 2003, Cook et al.
U.S. Appl. No. 60/518,075, filed Nov. 6, 2003, Pennell et al.
U.S. Appl. No. 60/544,771, filed Feb. 13, 2004, Cook et al.
U.S. Appl. No. 60/558,869, filed Apr. 1, 2004, Cook et al.
U.S. Appl. No. 60/583,609, filed Jun. 30, 2004, Alexandrov.
U.S. Appl. No. 60/583,691, filed Jun. 30, 2004, Alexandrov et al.
U.S. Appl. No. 60/612,891, filed Sep. 23, 2004, Kwok.
U.S. Appl. No. 60/637,140, filed Dec. 16, 2004, Feldmann.
U.S. Appl. No. 60/757,544, filed Jan. 9, 2006, Dang.
U.S. Appl. No. 60/776,307, filed Feb. 24, 2006, Kwok.
Authorized Officer J. Krüger, Supplementary European Search Report, Application No. EP 09710460.8, dated Oct. 11, 2011, 9 pages.
Authorized Officer C. H. Lee. International Search Report & Written Opinion, PCT/US2009/034068, dated Sep. 25, 2009, 13 pages.
Authorized officer Simin Baharlou, International Preliminary Report on Patentability from PCT/US2009/034068, dated Aug. 17, 2010, 7 pages.
Abler et al. "Isolation and characterization of a genomic sequence encoding the maize Cat3 catalase gene" Plant Mol. Biol., 22:1031-1038 (1993).
Alonso-Blanco et al., "The use of recombinant inbred lines (RILs) for genetic mapping," In Methods in Molecular Biology (J.M. Martinez-Zapater and J. Salinas, Humana Press, Totowa, NJ., 1998), 82: 137-146.
Baerson et al., "Developmental regulation of an acyl carrier protein gene promoter in vegetative and reproductive tissues" Plant Mol. Biol., 22(2):255-267 (1993).
Bateman et al., "Pfam 3.1: 1313 multiple alignments and profile HMMs match the majority of proteins" Nucl. Acids Res., 27(1):260-262 (1999).
Bechtold et al., "In planta Agrobacterium mediated gene transfer by infiltration of adult *Arabidopsis thaliana* plants" C.R. Acad. Sci. Paris, 316:1194-1199 (1993).
Berry & Bjorkman, "Photosynthetic response and adaptation to temperature in higher plants," Ann. Rev. Plant Physiol., 1980, 31: 491-543.
Braga et al., "Expression of the Cry1Ab protein in genetically modified sugarcane for the control of diatraea saccharalis," Journal of New Seeds, 2003, 5: 209-221.
Burr et al., "Gene mapping with recombinant inbreds in maize," Genetics, 1988, 118: 519-526.
Burr et al., "Mapping Genes with Recombinant Inbreds," In Freeling and Walbot (Ed.), The Maize Handbook, (New York, Springer-Verlag, 1994), pp. 249-254.
Bustos et al., "Regulation of b-glucuronidase expression in transgenic tobacco plants by an A/T-rich, cis-acting sequence found upstream of a French bean b-phaseolin gene" Plant Cell, 1(9):839-854 (1989).
Cerdan et al., "A 146 bp fragment of the tobacco Lhcb1*2 promoter confers very-low-fluence, low-fluence and high-irradiance responses of phytochrom to a minimal CaMV 35S promoter" Plant Mol. Biol., 33:245-255 (1997).
Cheikh and Jones, "Disruption of maize kernel growth and development by heat stress," Plant Physiol, 1994, 106: 45-51.
Chen et al., "Functional analysis of regulatory elements in a plant embryo-specific gene" Proc. Natl. Acad. Sci. USA, 83:8560-8564 (1986).
Chenna et al., "Multiple sequence alignment with the Clustal series of programs" Nucleic Acids Res., 31(13):3497-3500 (2003).
Conkling et al. "Isolation of transcriptionally regulated root-specific genes from tobacco" Plant Physiol., 93:1203-1211, (1990).
Dai et al., "RF2b, a rice bZIP transcription activator, interacts with RF2a and is involved in symptom development of rice tungro disease" Proc. Natl. Acad. Sci. USA, 101(2):687-692 (2004).
Database Accession No. Q9LHJ8, Oct. 2000, 2 pages.
Durbin et al., "3-Markov chains and hidden Markov models; 4-Pairwise alignment using HMMS; 5-Profile HMMs for sequence families" In Biological Sequence Analysis: Probabilistic Models of Proteins and Nucleic Acids, (Cambridge University Press, Cambridge, UK, 1998), pp. 47-134.
Fejes et al., "A 268 bp upstream sequence mediates the circadian clock-regulated transcription of the wheat Cab-1 gene in transgenic plants" Plant Mol. Biol., 15:921-932 (1990).
Fromm et al., "An octopine synthase enhancer element directs tissue-specific expression and binds ASF-1, a factor from tobacco nuclear extracts" The Plant Cell, 1:977-984 (1989).

(56) References Cited

OTHER PUBLICATIONS

GenBank Accession No. AF096096, dated Jan. 25, 1999, 2 pages.
GenBank Accession No. AF129516, dated Apr. 6, 1999, 2 pages.
GenBank Accession No. L05934, dated Oct. 22, 1993, 3 pages.
GenBank Accession No. U93215, dated Feb. 27, 2002, 42 pages.
Green et al., "Binding site requirements for pea nuclear protein factor GT-1 correlate with sequences required for light-dependent transcriptional activation of the rbcS-3A gene" EMBO J., 7:4035-4044 (1988).
Hong et al., "Promoter sequences from two different *Brassica napus* tapetal oleosin-like genes direct tapetal expression of ß-glucuronidase in transgenic *Brassica* plants" Plant Mol Biol., 1997 34(3):549-555.
Hwang et al, "Aleurone- and embryo-specific expression of the ß-glucuronidase gene controlled by the barley Chi26 and Ltp1 promoters in transgenic rice" Plant Cell Rep. 20(7):647-654 (2001).
Jang et al., "Expression of a bifunctional fusion of the *Escherichia coli* genes for trehalose-6-phosphate synthase and trehalose-6-phosphate phosphatase in transgenic rice plants increases trehalose accumulation and abiotic stress tolerance without stunting growth," Plant Physiology, 2003, 131: 516-524.
Jordano et al., "A sunflower helianthinin gene upstream sequence ensemble contains an enhancer and sites of nuclear protein interaction" Plant Cell, 1:855-866 (1989).
Kang et al., "*Arabidopsis* SAP5 functions as a positive regulator of stress responses and exhibits E3 ubiquitin ligase activity," Plant Mol. Biol., 2011, 75: 451-466.
Kasuga et al., "Improving plant drought, salt, and freezing tolerance by gene transfer of a single stress-inducible transcription factor," Nature Biotech, 1999, 17: 287-291.
Keller and Baumgartner, "Vascular-specific expression of the bean GRP 1.8 gene is negatively regulated" Plant Cell, 3(10):1051-1061 (1991).
Lam et al., "Site-specific mutations in alter in vitro factor binding and change promoter expression pattern in transgenic plants" Proc. Natl. Acad. Sci. USA, 86:7890-7894 (1989).
Luan et al., "A rice cab gene promoter contains separate cis-acting elements that regulate expression in dicot and monocot plants" The Plant Cell, 4:971-981 (1992).
Lubberstedt et al., "Promoters from genes for plastid proteins possess regions with different sensitivities toward red and blue light" Plant Physiol., 104:997-1006 (1994).
Maestri et al., "Molecular genetics of heat tolerance and heat shock proteins in cereals," Plant Mol. Biol., 2002, 48; 667-681.
Matsuoka et al., "Tissue-specific light-regulated expression directed by the promoter of a C4 gene, maize pyruvate, orthophosphate dikinase, in a C3 plant, rice" Proc. Natl. Acad. Sci. USA, 90:9586-9590 (1993).
Medberry et al., "The Commelina yellow mottle virus promoter is a strong promoter in vascular and reproductive tissues" Plant Cell, 4(2):185-192 (1992).
Meier et al., "Elicitor-inducible and constitutive in vivo DNA footprints indicate novel cis-acting elements in the promoter of a parsley gene encoding pathogenesis-related protein 1" Plant Cell, 3:309-316 (1991).
Refseth et al., "Hybridization capture of microsatellites directly from genomic DNA" Electrophoresis, 18:1519-1523 (1997).
Riggs et al., "Cotyledon nuclear proteins bind to DNA fragments harboring regulatory elements of phytohemagglutinin genes" Plant Cell, 1(6):609-621 (1989).
Rivera et al, "Genomic evidence for two functionally distinct gene classes" Proc. Natl. Acad. Sci. USA ,95:6239-6244 (1998).
Sheridan, "The mac1 Gene: Controlling the commitment to the meiotic pathway in Maize" Genetics, 142:1009-1020 (1996).
Slocombe et al., "Temporal and tissue-specific regulation of a *Brassica napus* stearoyl-acyl carrier protein desaturase gene" Plant Physiol., 104(4):1167-1176 (1994).
Sonnhammer et al., "Pfam: A comprehensive database of protein domain families based on seed alignments" Proteins, 28:405-420 (1997).

Sonnhammer et al., "Pfam: multiple sequence alignments and HMM-profiles of protein domains" Nucl. Acids Res., 26:320-322 (1998).
Suh et al., "Structural features required for the interaction of the Hsp70 molecular chaperone DnaK with its cochaperone DnaJ," *J Biol. Chem.*, 1999, 274(43):30534-30539.
Truernit et al., "The promoter of the *Arabidopsis thaliana* SUC2 sucrose-H+ symporter gene directs expression of ß-glucuronidase to the phloem: Evidence for phloem loading and unloading by SUC2" Planta. 196:564-570 (1995).
Urao et al. "Molecular cloning and characterization of a gene that encodes a MYC-related protein in *Arabidopsis*" Plant Mol. Biol., 32:571-576 (1996).
Vij and Tyagi, "Genome-wide analysis of the stress associated protein (SAP) gene family containing A20/AN1 zinc-finger(s) in rice and their phylogenetic relationship with *Arabidopsis*," Mol. Gen. Genomics, 2006, 276: 565-575.
Vogel et al., "Trehalose-6-phosphate phosphatases from *Arabidopsis thaliana*: identification by functional complementation of the yeast tps2 mutant," The Plant Journal, 1998, 13(5): 673-683.
Yamamoto et al., "The promoter of a pine photosynthetic gene allows expression of a ßglucuronidase reporter gene in transgenic rice plants in a light-independent but tissue-specific manner" Plant Cell Physiol., 1994, 35:773-778.
Zhang et al., "DNA sequences that activate isocitrate lyase gene expression during late embryogenesis and during postgerminative growth," Plant Physiology, 110:1069-1079 (1996).
Zheng et al., "SPK1 Is an Essential S-Phase-Specific Gene of *Saccharomyces cerevisiae* that encodes a nuclear serine/threonine/tyrosine kinase" Mol. Cell Biol., 1993, 13:5829-5842.
'Turf Screen' [online]. "Impact of Turf Screen on Drought Tolerance & Recovery of Turf," May 29, 2014, [retrieved on Jun. 18, 2014]. Retrieved from the Internet: URL http://turfscreen.com/blog/impact-of-turf-screen-on-drought-tolerance-recovery-of-turf/, 2 pages.
Day et al., "Transgene integration into the same chromosome location can produce alleles that express at a predictable level, or alleles that are differentially silenced," Genes Development, 2000, 14:2869-2880.
Frost et al., "The Tonoplast-Localized Sucrose Transporter in Populus (PtaSUT4) Regulates Whole-Plant Water Relations, Responses to Water Stress, and Photosynthesis," PLos ONE, 2012, 7(8):e44467, 10 pages.
Harb et al., "Molecular and Physiological Analysis of Drought Stress in *Arabidopsis* Reveals Early Responses Leading to Acclimation in Plant Growth," Plant Physiol., Nov. 2010, 154:1254-1271.
Hignight et al., "Turfgrass Water Conservation Protocol," Turfgrass Water Conservation Alliance, Retrieved on Jun. 18, 2014, 9 pages.
Industry News, "TWCA hosts AASCO seed control officials," Lawn & Landscape: Market Leadership, Sep. 9, 2010, 2 pages.
NTEP, "Drought Tolerance Testing of Cool-Season Grasses," NTEP Drought Tolerance Draft Proposal, Apr. 21, 2009, 2 pages.
Poudel, "Testing of Clonal Bermuda grass Cultivars and Experimental Genotypes for Differences in Drought Performance," Thesis, Oklahoma State Univ., Dec. 2010, 102 pages.
Unknown, "Zinc finger A20 and AN1 domain-containing stress-associated protein 5", Uniprot Accession No. Q9LHJ8, http://www.uniprot.org/uniprot/Q9LHJ8, Oct. 1, 2000.
Vij et al., "Genome-wide analysis of the stress associated protein (SAP) gene family containing A20/AN1 zinc-finger(s) in rice and their phylogenetic relationship with *Arabidopsis*," *Mol. Genet Genomics* 276(6):565-575, 2006.
Mukhopadhyay et al., "Overexpression of a zinc-finger protein gene from rice confers tolerance to cold, dehydration, and salt stress in transgenic tobacco," *Proc. Nat'l. Acad. Sci. USA* 101(16):6309-6314, 2004.
GenPept Accession No. NP_566429.1, dated Mar. 20, 2017.
Alfonso et al., "Unusual tolerance to high temperatures in a new herbicide-resistant D1 mutant from *Glycine max* (L.) Merr. cell cultures deficient in fatty acid desaturation," *Planta* 212:573-582, 2001.
Cho et al., "Constitutive expression of abiotic stress-inducible hot pepper CaXTH3, which encodes a xyloglucan endotransglucosylase/

(56) References Cited

OTHER PUBLICATIONS hydrolase homolog, improves drought and salt tolerance in transgenic *Arabidopsis* plants," *FEBS Letters* 580:3136-3144 2006.
Clarke et al., "Salicylic acid dependent signaling promotes basal thermotolerance but is not essential for acquired thermotolerance in *Arabidopsis thaliana*," *The Plant Journal* 38:432-447, 2004.

* cited by examiner

```
SEQ ID NO:584   MRK---VLV------AVLIVSMVAS|HFENVA|------------GPGDCYDGCS|TACVQRDPRK   22
SEQ ID NO:568   MMKKQVTIVA----ALLIMMALCS|SLNMVAEAQL------------------------------   50
SEQ ID NO:578   MKK---MVVA----MMLIFLLIST|QMESVE|----------------------------------   23

SEQ ID NO:584   ------------------SDAS----------GSGVSEQIDN|XMMKKQVTIV|AALLILVALS   26
SEQ ID NO:568   TSRCDRKCSI|RCGPDAARAS|-------------------------------------------   100
SEQ ID NO:578   ------------------PDAA----------------------------------------   27

SEQ ID NO:584   ----------|DCMDAC|--------|TTCVQSNTR|LTSRCDLKCG|RCGPDSEVEI|        62
SEQ ID NO:568   SNLDMVAEAQ|LGPGD|CYDGC|STACVQRDSR|KTSRCDRKCSI|RCGPDAKKA|         150
SEQ ID NO:578   ----------|DCLDGC|--------|TTACVQSDSR|LQARCDRKCSI|RCGPDSTIK|       63

SEQ ID NO:584   DHTFG--        66
SEQ ID NO:568   GETGA--        155
SEQ ID NO:578   EDMG---        67
```

|  |  |  |  |  |  |  |
|---|---|---|---|---|---|---|
| SEQ ID NO:682 | | | | | | 348 |
| SEQ ID NO:674 | | | | | | 332 |
| SEQ ID NO:634 | | | | | | 337 |
| SEQ ID NO:590 | YSSLPESI KK | SNCREVYIYR | NPFNVVASWF | | | 359 |
| SEQ ID NO:623 | | | | HFSNVEGEPE | KLDEEYF | 410 |
| SEQ ID NO:632 | | | | | | 348 |
| SEQ ID NO:627 | | | | | | 344 |

Figure 4 (continued)

| | | | | | | |
|---|---|---|---|---|---|---|
| SEQ ID NO:707 | MASNKVSFFL | VLCLCI L LAG | ECI ESPI FTG | NKCSDPT GMD | KDGKCLD YCH | 50 |
| SEQ ID NO:705 | MASNKVSFFL | VLCLCVLSTA | EFGEAQI LTG | IKCPDPNGHD | KEDKCN YCL | 50 |
| SEQ ID NO:706 | MASNKVSFF F | LFL CVLSTA | EFGEAQNPRG | RKCEDPNGVD | QKAKCY YCN | 50 |

| | | | | |
|---|---|---|---|---|
| SEQ ID NO:707 | AQGYP GGSCI | GFI DQGYMCV | CK VG | 74 |
| SEQ ID NO:705 | NQN Y MGGSCQ | GYKNH-YMCE | CYVG | 73 |
| SEQ ID NO:706 | EQGFLGGSCQ | GYT NH-YMCE | CYVG | 73 |

| SEQ_ID_NO:999 | SDRHGCSYDY | KSAARDAIAR | DNPVVRAAKI | VRF | 170 |
| --- | --- | --- | --- | --- | --- |
| SEQ_ID_NO:759 | SDRHDCSFDY | KAAGRESIAR | QNPVVKAAKI | IRL | 170 |
| SEQ_ID_NO:1215 | TDRHDCSYDY | KTVGREAIAK | ENPVVKAAKI | VKV | 137 |
| SEQ_ID_NO:799 | ADKHACTFDF | KKSDREKIAK | ENPLIVAPKI | TKF | 224 |
| SEQ_ID_NO:1010 | AEKHACDFDF | KAAGREKIAK | NNPLVVAAKI | | 193 |
| SEQ_ID_NO:857 | PEKHECSFDF | KFVGRGAIAK | ANPVVKADKV | | 175 |
| SEQ_ID_NO:796 | PGTTCLCLDL | | | | 137 |
| SEQ_ID_NO:801 | PEQHDCEFDF | KSLGKEQIAK | ANPVVKGEKL | QRI | 159 |
| SEQ_ID_NO:892 | PEQHGCGFDF | KGMGREEIAK | ANPVVKGEKL | NKI | 170 |
| SEQ_ID_NO:859 | PEKHACGFDF | KAVGREEIAR | ANPVIKGEKL | RRI | 164 |
| SEQ_ID_NO:763 | PENHGCTFDF | KKVGREEIAK | ANPLVKAEKL | EKI | 161 |
| SEQ_ID_NO:742 | PEVHGCTFDF | KSAGREEIAK | ANPLVIAAKL | QKI | 161 |
| SEQ_ID_NO:912 | PEVHGCTFDY | KKVAREQIAK | ANPLVVAAKL | QKI | 160 |
| SEQ_ID_NO:955 | TDSHQCTFDY | KKVAREQIAK | QNPVVMAEKI | NKI | 163 |
| SEQ_ID_NO:1000 | TDSHECTFDY | HVAAQEAIAK | ANPVVIAEKI | NKI | 159 |
| SEQ_ID_NO:1306 | ADVHNCSFDY | RSAAQDAIAK | ANPVVKADKL | DKL | 168 |
| SEQ_ID_NO:798 | SDKHDCPFDY | HTAARDIAK | ANPVVKAEKL | EKI | 173 |
| SEQ_ID_NO:953 | SDKHDCPYDY | HTAARDVAK | ANPVVKADKL | DKL | 173 |
| SEQ_ID_NO:988 | SDKHDCQFDY | RTAARDAIAK | ANPVVKAEKL | EKI | 171 |
| SEQ_ID_NO:991 | SDKHDCQFDY | RTAARDAIAK | ANPVVKAEKL | DKI | 171 |

| | | | | | | |
|---|---|---|---|---|---|---|
| SEQ ID NO:933 | QGRKVFEIRP | MIEWDKGKAL | EFLLESLGFG | NSNNVEPVYI | GDDRTDEDAF | 314 |
| SEQ ID NO:1142 | NGRMVLEVRP | VIDWDKGKAV | EFLLQSLGLN | DSENVIPIYI | GDDRTDEDAF | 323 |
| SEQ ID NO:1146 | NGRMVLEVRP | VIDWDKGKAV | EFLLOSLGLN | DSENVIPIYI | GDDRTDEDAF | 320 |
| SEQ ID NO:1140 | NGRMVLEVRP | VIDWDKGKAV | EFLLRSLGLN | DSEDVVPIYI | GDDRTDEDAF | 321 |
| SEQ ID NO:1144 | HGRKVLEVRP | VIDWDKGKAV | EFLLESLGLN | ESDDVLPIYI | GDDKTDEDAF | 333 |
| SEQ ID NO:926 | HGRKVLEVRP | VIDWNKGKAV | EFLLESLGLS | DRDDVLPIYV | GDDRTDEDAF | 337 |
| SEQ ID NO:1129 | HGRKVLEVRP | VIDWDKGKAV | TFLLESLGL- | NCEDVLPIYV | GDDRTDEDAF | 336 |
| SEQ ID NO:1148 | HGRKVLEVRP | VIDWDKGKAV | TFLLESLGL- | NCDDVLAYV | GDDRTDEDAF | 332 |
| SEQ ID NO:1150 | HGRKVLEIRP | ANWDKGKAL | EFLLESLGLDLS | NCDDVLPIYV | GDDRTDEDAF | 338 |
| SEQ ID NO:1182 | HGRKVLEVRP | VLNWDKGKAV | EFLLESLGLK | NCDDVLPIYV | GDDRTDEDAF | 333 |

| | | | | | | |
|---|---|---|---|---|---|---|
| SEQ ID NO:933 | KLLRDR-GEG | CGVLVSKFPK | DTDASTYLQD | PSEASDEFLA | TIGGVEITNA | 363 |
| SEQ ID NO:1142 | KVLRQR-NCG | YGILVSQVPK | ETEAFYSLRD | PSEV-MEFLN | FLVRWKKHSV | 371 |
| SEQ ID NO:1146 | KVLRKR-NCG | YGILVSQVPK | DTEAFYSLRD | PSEV-MAFLN | SLVRWKKHSL | 368 |
| SEQ ID NO:1140 | KVLRER-SCG | YGILVSSVPK | DTEAFYSLRD | PSEV-MGFLN | SLVRWKKHPL | 369 |
| SEQ ID NO:1144 | KVLKAN-NHG | FGILVSSVPK | DSDAFYSLRD | PSEV-MEFLR | TLAWKEGSS | 381 |
| SEQ ID NO:926 | KVLKEC-NMG | YGILVSSVPK | ESNAFSVRD | PSEV-KKFLK | ALVRWKRLEE | 386 |
| SEQ ID NO:1129 | KVLRDCPNHG | YGILVSAVPK | DSNAFYSLRD | PSEV-MEFLK | SLVTWKRSMG | 385 |
| SEQ ID NO:1148 | KVLKEA-NKG | YGILVSRAPK | ESNAYYSLRD | PSEV-MEFLT | SLAEWKSSLQ | 382 |
| SEQ ID NO:1150 | KVLRER-NCG | CGILVSKSPK | ESSAFYSLRD | PAEV-MEFLK | SLVTWKKSSA | 387 |
| SEQ ID NO:1182 | KVLREC-NKG | YGILVSAPK | ESSAFYSLRD | PSEV-MEFLK | CLVSWKKSSC | 384 |

| | |
|---|---|
| SEQ ID NO:933 | KSVKRMYV 371 |
| SEQ ID NO:1142 | -------- 371 |
| SEQ ID NO:1146 | -------- 368 |
| SEQ ID NO:1140 | -------- 369 |
| SEQ ID NO:1144 | A------- 381 |
| SEQ ID NO:926 | -------- 386 |
| SEQ ID NO:1129 | AR------ 385 |
| SEQ ID NO:1148 | L------- 382 |
| SEQ ID NO:1150 | FSY----- 387 |
| SEQ ID NO:1182 | -------- 384 |

Figure 9 (continued)

| SEQ ID NO | | | | | | |
|---|---|---|---|---|---|---|
| SEQ ID NO:74 | MYATLPSPFL | PKSLHAFSPN | KTSSSLRTSA | RAASFKSATA | TEGNS----- | 45 |
| SEQ ID NO:60 | -------MAGTL | VNSAGRFSPG | NCILPQQRTA | RFYSGTARFP | TGAPSFKAS- | 44 |
| SEQ ID NO:915 | -------MAGTL | VNSAGRFSPG | NCILPQQRTA | RFYSGTARFP | TGAPSFKAS- | 44 |
| SEQ ID NO:62 | -----MSGTLYS | AVNSLRSSPG | NS-LRQPKPT | RLHNGNAREP | TGATSFRASA | 47 |
| SEQ ID NO:152 | -----MSGTLYL | GVINSLRSSPG | NS-LRQPKPT | RLHNGNARLS | TGATSFRASA | 47 |
| SEQ ID NO:98 | ------MLSSLPTS | NSLLS----- | SI-SPPSA | SRIRFRPPLA | AASTAYFTSK | 41 |
| SEQ ID NO:102 | ---MSPRPAM | SPSFLAFRPG | SP-AASPPPS | PRLNGPPPLS | ASFSA---- | 42 |
| SEQ ID NO:104 | --------MA-FS | SSSSPCFFP- | ---SHNLTNL | RYNKHNSPM | SASFA---- | 35 |

| SEQ ID NO | | | | | | |
|---|---|---|---|---|---|---|
| SEQ ID NO:74 | AQTLNAEPAV | --AAVALAGS | LYEILRVERT | ASLNEIKTAY | RSLAKVYHPD | 83 |
| SEQ ID NO:60 | AQTLNAEPAV | TESVRRRVSS | LYELLKVNET | ASLTEIKTAY | RSLAKVVYHPD | 94 |
| SEQ ID NO:915 | AQTLNAEPAV | TESVRRRVSS | LYELLKVNET | ASLTEIKTAY | RSLAKVVYHPD | 94 |
| SEQ ID NO:62 | AQTLNAEPAV | TESVRRRASS | LYELLRVDET | ASLTEIKTAY | RSLAKVHHPD | 97 |
| SEQ ID NO:152 | AQTLNAEPAV | TESVRRRASN | LYELLRVDEI | ASLTEIKTAY | RSLAKVHHPD | 97 |
| SEQ ID NO:98 | QQKASPSGYL | SRPGMACTS | LYEVLGLSVG | ASNQEIKAAY | RRLARVCHPD | 91 |
| SEQ ID NO:102 | ---STAVTA | PDHAAJASS | FMDVLGLRPG | ASPREIKTAY | RRLALAVHPD | 88 |
| SEQ ID NO:104 | --TSERPGT | ARSTRATPSS | LYEVLGLQIG | ADTMEIKSAY | RRLARVMHPD | 82 |

| SEQ ID NO | | | | | | |
|---|---|---|---|---|---|---|
| SEQ ID NO:74 | A--------- | GRDFIEIRNA | YATLSDPTAR | AVYDMSLGVR | ---ARRIR-- | 125 |
| SEQ ID NO:60 | A--------- | GRDFMEIHKA | YATLADPTTR | AIYDSTLRVP | --RRRVHAGA | 137 |
| SEQ ID NO:915 | A--------- | GRDFMEIHKA | YATLADPTTR | AIYDSTLRVP | --RRRVHAGA | 137 |
| SEQ ID NO:62 | A--------- | GRDFMEIHKA | YATLADPTTR | AIYDSTLGAR | --GRRMHAGA | 141 |
| SEQ ID NO:152 | A--------- | ADEFMKIHAA | YATLADPTTR | AIYDSTLGAR | --GRRVHAGA | 141 |
| SEQ ID NO:98 | VTIDRKDSS | AEDFIRVHAA | YSTLSDPDKR | AVYDMSKL-W | ---RCQR-- | 134 |
| SEQ ID NO:102 | AP-HPASSS | AEDFMKVHSA | YSTLSDPDKR | ADYDRLLS | AGRRRAHPA- | 137 |
| SEQ ID NO:104 | V--GNLNSS | ADEFMKVHSA | YATLSDPGKR | ADYDRSLFV | ---RPEM-- | 122 |

| SEQ ID NO | | | |
|---|---|---|---|
| SEQ ID NO:74 | --TRVYP-- | ---RRWETDQ | CW | 140 |
| SEQ ID NO:60 | MGRSGRVYA- | TTRRWETDQ | CW | 157 |
| SEQ ID NO:915 | MGRSGRVYA- | TTRRWETDQ | CW | 157 |
| SEQ ID NO:62 | TGRTSRVYP- | TTRRWETDQ | CW | 161 |
| SEQ ID NO:152 | MGRTSRVYP- | TTRRWETDQ | CW | 161 |
| SEQ ID NO:98 | PLTSASMFSG | YTGRSWETDQ | CW | 156 |
| SEQ ID NO:102 | LGRSPSFPAR | RSRRTWETDQ | CW | 159 |
| SEQ ID NO:104 | VGRSCS-PVG | YSGRRWETDQ | CW | 143 |

| SEQ ID NO | | | | | | |
|---|---|---|---|---|---|---|
| SEQ ID NO:408 | QKRRLTMTP- | | | | | 235 |
| SEQ ID NO:364 | RKRRLTSTP- | | | | | 250 |
| SEQ ID NO:407 | RKRRLTASP- | | | | | 247 |
| SEQ ID NO:421 | RRLKQDGIAE | TTEQATPPDG | QIVKYQPMMN | ETAKAMLRKI | MKWDTPRVES | 287 |
| SEQ ID NO:410 | RRRPI-DNTP- | | | | | 253 |
| SEQ ID NO:413 | RRRPI-DNMP- | | | | | 249 |
| SEQ ID NO:408 | ---------- | ---------- | ---------- | ---------- | ---------- | 250 |
| SEQ ID NO:364 | ---------- | SVTG | SDQPM-NYSS | SL- | ---------- | 262 |
| SEQ ID NO:407 | ---------- | SLGT | MEENL- | ---HD- | ---------- | 270 |
| SEQ ID NO:421 | FNKNPDNYLI | GDCTSPSSAM | LQEVASVALG | SSQFVDYMN- | SVQSTQIPMS | 337 |
| SEQ ID NO:410 | -------FY | SDG------- | DSSSSTSWNS | GVTLQEVPPS | ---------- | 280 |
| SEQ ID NO:413 | -------FY | -EISEQ | LDSQDKMFES | GV-LNGLNE- | GI-------- | 281 |
| | | DPGETSQTEQ | LDSPY-LFDS | CV-LNELSEP | | |
| SEQ ID NO:408 | ---------- | ---------- | ---------- | ---------- | ---------- | 250 |
| SEQ ID NO:364 | ---------- | ---------- | ---------- | ---------- | ---------- | 262 |
| SEQ ID NO:407 | ---------- | ---------- | ---------- | ---------- | ---------- | 270 |
| SEQ ID NO:421 | TGTQGHIPSA | EKPEILSVPQ | AAASANVMKD | GTHAASTIPT | SQADVIMPDI | 387 |
| SEQ ID NO:410 | ---------- | ---------- | ---------- | ---------- | ---------- | 280 |
| SEQ ID NO:413 | ---------- | ---------- | ---------- | ---------- | ---------- | 281 |
| SEQ ID NO:408 | ---------- | ---------- | QESEAELAS- | EMLFSAAMD | NESSSNVRPD | 279 |
| SEQ ID NO:364 | ---------- | ---------- | QEFDRMKDD | MEMLFAAAID | DEANNSM--- | 288 |
| SEQ ID NO:407 | ---------- | ---------- | QDLPTIENE- | METLFSAVLD | NESSSDIKDP | 299 |
| SEQ ID NO:421 | PSVPEIVPKS | ILDIPEDNYM | APETDDGFMD | PSSLGSLPDD | ---LDC---- | 430 |
| SEQ ID NO:410 | ---------- | ---------- | PELENLAVN- | QELGKGSID | ---DGN---- | 302 |
| SEQ ID NO:413 | ---------- | ---------- | PELENLAVN- | QDLGKGKVD | ---EER---- | 303 |
| SEQ ID NO:408 | SV-------- | GTDMEPVADD | WEELLSEDL | ISGDRAAEEV | VVVEQPEFD | 324 |
| SEQ ID NO:364 | ---PTKE-- | EQCLEAMNVM | MRDGNL | ---EAAID- | ---------- | 313 |
| SEQ ID NO:407 | IASSMDTASG | GSTLDAVNET | WEELLTDDL | VSGE--PNEV | VVSDEPEVD- | 346 |
| SEQ ID NO:421 | ---LSPG--- | ADIDDLSNS | WDDLLQTPL | PEDF------ | ---EANLDE- | 464 |
| SEQ ID NO:410 | ---LTQV--- | SDQSE-LNDD | FMAELLVEDF | GDKA------ | GQPELE---- | 335 |
| SEQ ID NO:413 | ---QNQT--- | NCQAE-LGDD | FMAELLVEDF | TGKE------ | EQSELD---- | 336 |

| SEQ ID NO | Sequence | Position |
|---|---|---|
| SEQ-ID-NO:282 | VVLLYLLISA FCCGLSLPSC RS | 221 |
| SEQ-ID-NO:256 | LVIVYIALFF VCHGFTLPTC R | 221 |
| SEQ-ID-NO:268 | LVIIYVVLVF VCHGFTLPTC R | 221 |
| SEQ-ID-NO:294 | TMIYVVLMF MCHGFTLPTC L | 221 |
| SEQ-ID-NO:160 | LVIYIAVAF LCHGPTLPSC F | 219 |
| SEQ-ID-NO:242 | LVIVYVVLAF VCHGPALPSC F | 219 |
| SEQ-ID-NO:253 | VIAYVVLAF VCHGPALPTC F | 219 |
| SEQ-ID-NO:162 | LIIYVVLAF VCHGITLPTC K | 220 |
| SEQ-ID-NO:184 | LVIYVVLAF VCHGLTLPTC LK | 220 |

| | | | | | |
|---|---|---|---|---|---|
| SEQ ID NO: 1201 | MAQRDKK--EE | PTELRAPEL- | ---------- | ---------- | NCGFPGNPAT | QNLCQSCFSA | 43 |
| SEQ ID NO: 1207 | MAQRDKKVEE- | PTELRAPEL- | ---------- | T--------- | SCGFPGNPAT | NNLCQACFQA | 44 |
| SEQ ID NO: 1195 | MAQRTEK---- | ETEFKVPETL | ---------- | T--------- | NCGVTGNPAT | NNMCQKCFSA | 43 |
| SEQ ID NO: 749  | MAQRTEK---E | ETEFKVLETL | ---------- | TTTTTLCTN- | NCGVTANPAT | NNMCQKCFNA | 48 |

| SEQ ID NO: 1201 | ATASMSSSPI- | S--SSSSTA- | ---------- | PAPAA----- | PPQPRPAPAE | LASPADAAVA | 86 |
| SEQ ID NO: 1207 | ATASSSASV-- | SPPSPSSSLS | ---------- | PSPAVFKFDE | QQHARPSATA | -VFADRPAEQ | 93 |
| SEQ ID NO: 1195 | TTAATSSSSS- | S--SSTNNTA | ---------- | TSATD----- | DKSSRSTPTR | -SQDNRSDSA | 85 |
| SEQ ID NO: 749  | SLVSAAAGVM- | E--SGSIL-- | ---------- | ---------- | KRSARSVNLR | -SSPAKVVLR | 83 |

| SEQ ID NO: 1201 | APAPEAAKAP  | ARIT------ | ---------- | ---------- | -SANRCSSCR | KRVGLTGFRC | 118 |
| SEQ ID NO: 1207 | PPAPASARPI  | RITTS----- | ---------- | ---------- | SSVNRCSGCR | KRVGLTGFRC | 131 |
| SEQ ID NO: 1195 | PPITAATTAT  | ATTNSPMTAS | NRSGYDIAEK | TSSS------ | KSVNRCSGCR | KIVGLTGFRC | 135 |
| SEQ ID NO: 749  | PREIDAVKKR  | DQQ------- | ---------- | ---------- | VNRCSGCR   | KKVGLTGFRC | 115 |

| SEQ ID NO: 1201 | RCGELFCGAH | RYSDRHGCSY | DYKCAARDAI | ARENPVVRAA | KIVRF | 163 |
| SEQ ID NO: 1207 | RCGELFCGAH | RYSDRHDCCF | DYKAVGRDAI | ARENPVVRAA | KIVRF | 176 |
| SEQ ID NO: 1195 | RCGELFCSDH | RYSDRHDCSY | DYKAAGREAI | ARENPVVKAA | KIIRV | 180 |
| SEQ ID NO: 749  | RCGELFCSEH | RYSDRHDCSY | DYKITAGREAI | ARENPVVKAA | KMVKV | 160 |

Figure 15

| | | | | | |
|---|---|---|---|---|---|
|SEQ_ID_NO:1360|MAL-QISKKR|KFVADGVFLA|ELNEMLTREL|GEDGFAGVEI|RVTPMRTEII 49|
|SEQ_ID_NO:1340|MAT-QISKKK|KFVSDGVFYA|ELNEMLTREL|AEDGYSGVEV|RVTPMRTEII 49|
|SEQ_ID_NO:1347|MAT-QISKKR|KFVSDGVFYA|ELNEVLTREL|AEDGYSGVEV|RVTPMRTEII 49|
|SEQ_ID_NO:1311|MAT-QISKKR|KFVADGVFYA|ELNEVLTREL|AEDGYSGVEV|RVTPMRTEII 49|
|SEQ_ID_NO:1313|MAT-QMSKKR|KFVADGVFYA|ELNEVLTREL|AEDGYSGVEV|RVTPMRTEII 49|
|SEQ_ID_NO:1353|MAT-QISKKR|KFVADGVFFA|ELNEVLTREL|AEDGYSGVEV|RVTPMRTEII 49|
|SEQ_ID_NO:1331|MATAQISKKR|KFVADGVFEA|ELNEVLTREL|AEDGYSGVEV|RVTPMRTEII 50|

| | | | | | |
|---|---|---|---|---|---|
|SEQ_ID_NO:1360|RATRTQNVL|GEKGRRIREL|TSVVQKRFNF|PDGGVELYAE|KVLNRGLCAV 99|
|SEQ_ID_NO:1340|RATRTQNVL|GEKGRRIREL|TSVVQKRFNF|PENGVELYAE|KVVNRGLCAI 99|
|SEQ_ID_NO:1347|RATRTQNVL|GEKGRRIREL|TSVVQKRFNF|PENGVELYAE|KVANRGLCAI 99|
|SEQ_ID_NO:1311|RATRTQNVL|GEKGRRIREL|TSLVQKRFKF|PQDSVELYAE|KVANRGLCAI 99|
|SEQ_ID_NO:1313|RATRTQNVL|GEKGRRIREL|TSLVQKRFRF|PQDSVELYAE|KVANRGLCAI 99|
|SEQ_ID_NO:1353|RATRTQAVL|GEKGRRIREL|TSVVQKRFKF|PENSVELYAE|KVNHRGLCAI 99|
|SEQ_ID_NO:1331|RATRTQNVL|GEKGRRIREL|TSVVQKRFKF|PENSVELYAE|KVNNRGLCAI 100|

| | | | | | |
|---|---|---|---|---|---|
|SEQ_ID_NO:1360|AQAESLRYKL|GGLAVRRAC|YGVLRFVMES|GAKGCEVIVS|GKLRAQRAKS 149|
|SEQ_ID_NO:1340|AQAESLRYKL|GGLAVRRAC|YGVLRFVMES|GAKGCEVIVS|GKLRAQRAKS 149|
|SEQ_ID_NO:1347|AQAESLRYKL|GGLAVRRAC|YGVLRFVMES|GAKGCEVIVS|GKLRAQRAKS 149|
|SEQ_ID_NO:1311|AQAESLRYKL|GGLAVRRAC|YGVLRYVMES|GAKGCEVIVS|GKLRAARAKS 149|
|SEQ_ID_NO:1313|AQAESLRYKL|GGLAVRRAC|YGVLRFVMES|GAKGCEVIVS|GKLRAARAKE 148|
|SEQ_ID_NO:1353|AQAESLRYKL|GGLAVRRMC|YGVLRFVMES|GAKGCEVIVS|GKLRAQRAKS 149|
|SEQ_ID_NO:1331|AQAESLRYKL|GGLAVRRAC|YGVLREIMES|GAKGCEVIVS|GKLRAQRAKS 150|

| | | | | | |
|---|---|---|---|---|---|
|SEQ_ID_NO:1360| | | | | 149|
|SEQ_ID_NO:1340|MKFKDGYMIS|SGQPVNEYID|AAVRHVLLRQ|GVLGIKVKIM|LDWDPK 195|
|SEQ_ID_NO:1347|MKFKDGYMIS|SGQPVNEYLD| | | 169|
|SEQ_ID_NO:1311|ML| | | | 148|
|SEQ_ID_NO:1313|MKFKDGYMIS|SGQPVKDYID|SAVRHVLLRQ|GVI| 150|
|SEQ_ID_NO:1353|MKFKDGYMIS|SGHPVNEYLD|SAVRHVLLRF| | 181|
|SEQ_ID_NO:1331| | | | | 179|

Figure 16

DROUGHT AND HEAT TOLERANCE IN PLANTS

CROSS-REFERENCE TO RELATED APPLICATIONS

This application is a divisional of U.S. application Ser. No. 12/856,204, filed on Aug. 13, 2010, which is a continuation of International Application No. PCT/US2009/034068, filed Feb. 13, 2009, which claims the benefit of U.S. Provisional Application No. 61/029,048, filed Feb. 15, 2008. The contents of all of the foregoing applications are hereby incorporated by reference in their entireties.

TECHNICAL FIELD

This document relates to methods and materials involved in modulating drought and/or heat tolerance in plants. For example, this document provides plants having increased drought and/or heat tolerance as well as materials and methods for making plants having increased drought and/or heat tolerance.

BACKGROUND

Due to their sessile nature, plants are constantly under the threat of temperature stress when they are subjected to a wide range of temperature variation in different habitats and climates during growing seasons and even diurnally. Most economically valuable plants, including those used in agriculture, horticulture, forestry, biomass for bioconversion, and other industries (e.g., the paper industry or pharmaceutical/chemical industries where plants are used as production factories for proteins or other compounds) are exposed to higher than optimal temperatures, or heat stress, during some stages of their life cycle from seed germination to seed maturation (Maestri et al. *Plant Mol. Biol.* 48:667-681 (2002)). Heat stress is one of the most common stresses in crop production. Under heat stress, plants can succumb to a variety of physiological and developmental damages, including dehydration due to increased transpiration, impairment of photosynthetic carbon assimilation, inhibition of translocation of assimilates, increased respiration, reduced organ size due to a decrease in the duration of developmental phases, disruption of seed development, and a reduction in fertility (Berry and Bjorkman, *Ann. Rev. Plant Physiol.* 31:491-543 (1980); Cheikh and Jones, *Plant Physiol.* 106: 45-51 (1994)). Thus, exposure to heat stress often results in reduced yield and overall decreased crop quality (Maestri et al. *Plant Mol. Biol.* 48:667-681 (2002)).

In the field, heat stress is often associated with other stresses, such as drought and high light, which presents even greater challenge to plants. Plants exposed to low water or drought conditions typically have low yields of plant material, seeds, fruit and other edible products. Some areas of the world consistently have very low rainfall and therefore have problems growing sufficient food crops for their population.

Thus, there is a need for methods of increasing drought and/or heat tolerance in plants.

SUMMARY

This document provides methods and materials related to plants having increased heat and/or drought tolerance. For example, this document provides transgenic plants and plant cells having increased heat and/or drought tolerance, nucleic acids used to generate transgenic plants and plant cells having increased heat and/or drought tolerance, and methods for making plants and plant cells having increased heat and/or drought tolerance. Such plants having increased heat and/or drought tolerance may be useful to produce biomass which may be converted to a liquid fuel or other chemicals and/or to produce crops with increased yield and/or quality.

Methods of producing a plant are provided herein. In one aspect, a method comprises growing a plant cell comprising an exogenous nucleic acid. The exogenous nucleic acid comprises a regulatory region operably linked to a nucleotide sequence encoding a polypeptide. The Hidden Markov Model (HMM) bit score of the amino acid sequence of the polypeptide is greater than about 20, using an HMM generated from the amino acid sequences depicted in one of FIGS. 1-16. The plant has a difference in drought tolerance or heat tolerance as compared to a control plant that does not comprise the exogenous nucleic acid.

In another aspect, a method comprises growing a plant cell comprising an exogenous nucleic acid. The exogenous nucleic acid comprises a regulatory region operably linked to a nucleotide sequence encoding a polypeptide having 80 percent or greater sequence identity to an amino acid sequence set forth in SEQ ID NO: 2, 3, 4, 5, 6, 7, 8, 9, 10, 11, 13, 15, 17, 19, 21, 23, 25, 27, 29, 31, 33, 35, 37, 39, 41, 43, 45, 47, 49, 51, 53, 55, 57, 60, 62, 63, 64, 65, 66, 67, 68, 69, 70, 71, 73, 74, 76, 78, 80, 82, 84, 86, 88, 90, 92, 94, 96, 98, 100, 102, 104, 106, 108, 110, 112, 114, 116, 118, 120, 122, 124, 126, 127, 130, 132, 134, 136, 138, 139, 142, 144, 146, 148, 150, 152, 154, 156, 158, 160, 162, 164, 166, 168, 170, 172, 174, 176, 178, 179, 180, 182, 184, 186, 188, 190, 192, 194, 196, 198, 200, 202, 204, 206, 208, 209, 212, 214, 216, 218, 220, 222, 224, 225, 228, 229, 231, 233, 234, 235, 237, 239, 240, 242, 244, 246, 248, 250, 252, 253, 254, 256, 258, 260, 262, 264, 266, 268, 269, 271, 273, 275, 277, 279, 280, 282, 284, 286, 288, 289, 290, 291, 292, 293, 294, 295, 296, 297, 298, 299, 300, 301, 302, 303, 304, 305, 307, 309, 311, 312, 314, 315, 316, 317, 319, 320, 321, 322, 323, 325, 326, 327, 329, 330, 332, 334, 335, 336, 337, 338, 339, 340, 341, 343, 344, 346, 348, 349, 350, 351, 353, 355, 356, 358, 360, 362, 364, 366, 368, 369, 370, 371, 373, 375, 377, 379, 381, 383, 385, 387, 389, 390, 392, 394, 396, 398, 400, 401, 402, 404, 405, 407, 408, 410, 412, 413, 414, 416, 418, 419, 420, 421, 422, 423, 424, 426, 428, 430, 431, 432, 433, 434, 435, 436, 438, 440, 442, 443, 445, 447, 449, 451, 453, 455, 457, 459, 461, 463, 465, 467, 469, 470, 472, 474, 476, 478, 480, 481, 483, 485, 487, 489, 490, 491, 492, 494, 496, 498, 500, 502, 504, 506, 508, 510, 512, 514, 515, 516, 518, 519, 520, 522, 524, 526, 528, 530, 531, 533, 535, 536, 538, 540, 541, 543, 545, 547, 548, 550, 552, 553, 555, 557, 558, 559, 561, 562, 564, 566, 568, 569, 570, 572, 574, 576, 578, 580, 582, 584, 586, 588, 590, 591, 592, 593, 594, 595, 596, 597, 598, 599, 600, 602, 603, 604, 605, 607, 608, 610, 612, 614, 615, 616, 617, 618, 619, 620, 621, 623, 625, 627, 629, 631, 632, 634, 635, 636, 638, 640, 642, 644, 646, 647, 648, 650, 651, 653, 654, 655, 656, 658, 660, 661, 662, 663, 664, 665, 666, 667, 668, 669, 671, 673, 674, 675, 676, 678, 680, 682, 684, 685, 687, 688, 690, 691, 692, 694, 696, 698, 700, 702, 705, 706, 707, 708, 709, 711, 712, 714, 715, 717, 719, 721, 723, 725, 726, 727, 729, 731, 733, 734, 735, 737, 738, 740, 741, 742, 743, 744, 745, 746, 747, 748, 749, 751, 752, 753, 754, 755, 756, 757, 759, 760, 761, 763, 765, 767, 768, 769, 771, 773, 774, 775, 777, 779, 781, 783, 785, 787, 789, 791, 793, 795, 796, 797, 798, 799, 801, 803, 805, 807, 808, 809, 810, 811, 812, 813, 815, 816, 817, 819, 821, 823, 825, 827, 829, 832, 834, 836, 839, 840, 841, 842, 843, 844, 845, 846, 848, 849, 850, 851, 852, 853, 854, 856, 857, 859, 861, 863, 865, 867, 869, 870, 871, 872, 873, 874, 876, 878, 880, 882, 885, 886, 887, 888, 889, 890, 891, 892, 893, 894, 896, 897, 898, 900, 901, 902, 904, 906, 908, 910, 912, 913, 914, 915, 916, 918, 920, 922, 924, 926, 929, 931, 932, 933, 935, 937, 939, 941, 943, 944, 945, 947, 949, 951, 952, 953, 955, 957, 958, 959, 960, 961, 962, 963, 964, 966, 968, 969, 970, 971, 973, 974, 975, 977, 978, 979, 980, 981, 983, 985, 987, 988, 989, 990, 991, 992, 993, 995, 997, 998, 999, 1000, 1001, 1003, 1005, 1007, 1010, 1012, 1013, 1014, 1015, 1016, 1018, 1020, 1022, 1023, 1025, 1027, 1028, 1030, 1031, 1033, 1035, 1037, 1039, 1041, 1043, 1045, 1046, 1048, 1050, 1051, 1053, 1055, 1056, 1058, 1059, 1061, 1062, 1064, 1066, 1068, 1069, 1071, 1073, 1075, 1077, 1079, 1080, 1082, 1084, 1086, 1088, 1090, 1092, 1093, 1094, 1096, 1098, 1100, 1102, 1104, 1106, 1108, 1110, 1112, 1113, 1114, 1116, 1117, 1118, 1119, 1121, 1123, 1125, 1129, 1130, 1131, 1132, 1133, 1134, 1135, 1136, 1137, 1138, 1140, 1142, 1144, 1146, 1148, 1150, 1151, 1152, 1153, 1154, 1156, 1157, 1158, 1159, 1160, 1161, 1162, 1164, 1166, 1168, 1170, 1172, 1174, 1175, 1177, 1179, 1181, 1182, 1184, 1186, 1188, 1189, 1191, 1193, 1195, 1197, 1199, 1201, 1203, 1205, 1207, 1209, 1210, 1212, 1214, 1215, 1216, 1218, 1219, 1221, 1222, 1223, 1225, 1226, 1228, 1230, 1231, 1232, 1234, 1236, 1238, 1240, 1242, 1244, 1246, 1248, 1250, 1252, 1254, 1256, 1258, 1262, 1264, 1265, 1267, 1269, 1271, 1273, 1274, 1276, 1277, 1279, 1281, 1283, 1285, 1286, 1287, 1288, 1290, 1292, 1293, 1294, 1296, 1298, 1300, 1302, 1304, 1306, 1311, 1313, 1315, 1317, 1319, 1321, 1323, 1324, 1325, 1326, 1327, 1329, 1331, 1333, 1334, 1336, 1338, 1340, 1342, 1343, 1345, 1347, 1349, 1350, 1351, 1353, 1354, 1356, 1358, 1360, or 1361. A plant produced from the plant cell has a difference in drought tolerance or heat tolerance compared to a control plant that does not comprise the exogenous nucleic acid.

In another aspect, the polypeptide can comprise a sulfotransferase 1 domain having 70 percent or greater sequence identity to the sulfotransferase 1 domain of SEQ ID NO:590 or orthologs thereof such as those identified in the sequence listing; an AN1-like zinc finger domain having 70 percent or greater sequence identity to the AN1-like zinc finger domain of SEQ ID NO:742 or SEQ ID NO:749 or orthologs thereof such as those identified in the sequence listing and an A20-like zinc finger domain having 70 percent or greater sequence identity to the A20-like zinc finger domain of SEQ ID NO:742 or SEQ ID NO:749 or orthologs thereof such as those identified in the sequence listing; a short chain dehydrogenase domain having 70 percent or greater sequence identity to the short chain dehydrogenase domain of SEQ ID NO:1012 or orthologs thereof such as those identified in the sequence listing; a trehalose-phosphatase domain having 70 percent or greater sequence identity to the trehalose-phosphatase domain of or SEQ ID NO:1129 or orthologs thereof such as those identified in the sequence listing; a synaptobrevin-related polypeptide having 70 percent or greater sequence identity to the synaptobrevin-related polypeptide of SEQ ID NO:160 or orthologs thereof such as those identified in the sequence listing; an HSF-type DNA-binding domain having 70 percent or greater sequence identity to the HSF-type DNA-binding domain of SEQ ID NO:311 or SEQ ID NO:364 or orthologs thereof such as those identified in the sequence listing; a DnaJ domain having 70 percent or greater sequence identity to the DnaJ domain of SEQ ID NO:60 or orthologs thereof such as those identified in the sequence listing; or a KH_2 domain having 70 percent or greater sequence identity to the KH_2 domain of SEQ ID NO:1311 or orthologs thereof such as those identified in the sequence listing.

In another aspect, a method comprises growing a plant cell comprising an exogenous nucleic acid. The exogenous nucleic acid comprises a regulatory region operably linked to a nucleotide sequence having 80 percent or greater sequence identity to a nucleotide sequence, or a fragment thereof, set forth in SEQ ID NO: 1, 12, 14, 16, 18, 20, 22, 24, 26, 28, 30, 32, 34, 36, 38, 40, 42, 44, 46, 48, 50, 52, 54, 56, 58, 59, 61, 72, 75, 77, 79, 81, 83, 85, 87, 89, 91, 93, 95, 97, 99, 101, 103, 105, 107, 109, 111, 113, 115, 117, 119, 121, 123, 125, 128, 129, 131, 133, 135, 137, 140, 141, 143, 145, 147, 149, 151, 153, 155, 157, 159, 161, 163, 165, 167, 169, 171, 173, 175, 177, 181, 183, 185, 187, 189, 191, 193, 195, 197, 199, 201, 203, 205, 207, 210, 211, 213, 215, 217, 219, 221, 223, 226, 227, 230, 232, 236, 238, 241, 243, 245, 247, 249, 251, 255, 257, 259, 261, 263, 265, 267, 270, 272, 274, 276, 278, 281, 283, 285, 287, 306, 308, 310, 313, 318, 324, 328, 331, 333, 342, 345, 347, 352, 354, 357, 359, 361, 363, 365, 367, 372, 374, 376, 378, 380, 382, 384, 386, 388, 391, 393, 395, 397, 399, 403, 406, 409, 411, 415, 417, 425, 427, 429, 437, 439, 441, 444, 446, 448, 450, 452, 454, 456, 458, 460, 462, 464, 466, 468, 471, 473, 475, 477, 479, 482, 484, 486, 488, 493, 495, 497, 499, 501, 503, 505, 507, 509, 511, 513, 517, 521, 523, 525, 527, 529, 532, 534, 537, 539, 542, 544, 546, 549, 551, 554, 556, 560, 563, 565, 567, 571, 573, 575, 577, 579, 581, 583, 585, 587, 589, 601, 606, 609, 611, 613, 622, 624, 626, 628, 630, 633, 637, 639, 641, 643, 645, 649, 652, 657, 659, 670, 672, 677, 679, 681, 683, 686, 689, 693, 695, 697, 699, 701, 703, 704, 710, 713, 716, 718, 720, 722, 724, 728, 730, 732, 736, 739, 750, 758, 762, 764, 766, 770, 772, 776, 778, 780, 782, 784, 786, 788, 790, 792, 794, 800, 802, 804, 806, 814, 818, 820, 822, 824, 826, 828, 830, 831, 833, 835, 837, 838, 847, 855, 858, 860, 862, 864, 866, 868, 875, 877, 879, 881, 883, 884, 895, 899, 903, 905, 907, 909, 911, 917, 919, 921, 923, 925, 927, 928, 930, 934, 936, 938, 940, 942, 946, 948, 950, 954, 956, 965, 967, 972, 976, 982, 984, 986, 994, 996, 1002, 1004, 1006, 1008, 1009, 1011, 1017, 1019, 1021, 1024, 1026, 1029, 1032, 1034, 1036, 1038, 1040, 1042, 1044, 1047, 1049, 1052, 1054, 1057, 1060, 1063, 1065, 1067, 1070, 1072, 1074, 1076, 1078, 1081, 1083, 1085, 1087, 1089, 1091, 1095, 1097, 1099, 1101, 1103, 1105, 1107, 1109, 1111, 1115, 1120, 1122, 1124, 1126, 1127, 1128, 1139, 1141, 1143, 1145, 1147, 1149, 1155, 1163, 1165, 1167, 1169, 1171, 1173, 1176, 1178, 1180, 1183, 1185, 1187, 1190, 1192, 1194, 1196, 1198, 1200, 1202, 1204, 1206, 1208, 1211, 1213, 1217, 1220, 1224, 1227, 1229, 1233, 1235, 1237, 1239, 1241, 1243, 1245, 1247, 1249, 1251, 1253, 1255, 1257, 1259, 1260, 1261, 1263, 1266, 1268, 1270, 1272, 1275, 1278, 1280, 1282, 1284, 1289, 1291, 1295, 1297, 1299, 1301, 1303, 1305, 1312, 1314, 1316, 1318, 1320, 1322, 1328, 1330, 1332, 1335, 1337, 1339, 1341, 1344, 1346, 1348, 1352, 1355, 1357, 1359 or 1362, or a fragment thereof. A plant produced from the plant cell has a difference in drought tolerance or heat tolerance as compared to a control plant that does not comprise the exogenous nucleic acid.

Methods of modulating drought in a plant are provided herein. In one aspect, a method comprises introducing into a plant cell an exogenous nucleic acid, that comprises a regulatory region operably linked to a nucleotide sequence encoding a polypeptide. The HMM bit score of the amino acid sequence of the polypeptide is greater than about 20, using an HMM generated from the amino acid sequences depicted in one of FIGS. 1-16. A plant produced from the plant cell has a difference in drought tolerance as compared to a control plant that does not comprise the exogenous nucleic acid.

In another aspect, a method of modulating drought tolerance comprises introducing into a plant cell an exogenous nucleic acid that comprises a regulatory region operably linked to a nucleotide sequence encoding a polypeptide having 80 percent or greater sequence identity to an amino acid sequence set forth in SEQ ID NO: 442, 443, 445, 447, 449, 451, 453, 455, 457, 459, 461, 463, 465, 469, 470, 472, 474, 476, 478, 480, 481, 483, 485, 487, 966, 968, 969, 970, 902, 904, 906, 908, 910, 913, 914, 920, 748, 749, 797, 803, 821, 1189, 1191, 1193, 1195, 1197, 1199, 1201, 1203, 1205, 1207, 1209, 1210, 1212, 1214, 1215, 1216, 1218, 1219, 1221, 1222, 1223, 1225, 1226, 1228, 1230, 1231, 1232, 1234, 1236, 1238, 1240, 1244, 1246, 1248, 1250, 1252, 1254, 1256, 1258, 1296, 1298, 1300, 1302, 1304, 489, 490, 491, 492, 494, 496, 498, 500, 502, 504, 506, 508, 510, 512, 514, 515, 516, 518, 519, 520, 522, 524, 526, 528, 530, 531, 533, 535, 536, 538, 540, 541, 543, 545, 547, 548, 550, 552, 553, 555, 557, 558, 561, 562, 564, 566, 856, 869, 870, 871, 872, 873, 874, 568, 569, 570, 572, 574, 576, 578, 580, 582, 584, 586, 588, 795, 590, 591, 592, 593, 594, 595, 596, 597, 598, 599, 600, 602, 603, 604, 605, 607, 608, 610, 612, 614, 615, 616, 617, 618, 619, 620, 621, 623, 625, 627, 629, 631, 632, 634, 635, 636, 638, 640, 642, 644, 646, 647, 650, 651, 653, 654, 655, 656, 658, 660, 661, 662, 663, 664, 665, 666, 667, 668, 669, 671, 673, 674, 675, 676, 678, 680, 682, 684, 685, 687, 688, 690, 691, 692, 694, 696, 698, 700, 702, 971, 974, 975, 978, 979, 980, 981, 983, 985, 987, 995, 997, 705, 706, 707, 708, 709, 711, 712, 714, 715, 717, 719, 721, 723, 725, 727, 729, 731, 733, 734, 735, 737, 738, 740, 746, 747, 751, 752, 787, 742, 743, 744, 745, 757, 759, 761, 763, 767, 771, 796, 798, 799, 801, 805, 807, 808, 809, 810, 811, 812, 813, 815, 816, 817, 819, 823, 825, 832, 834, 836, 839, 846, 848, 857, 859, 863, 885, 892, 900, 912, 918, 939, 944, 953, 955, 957, 973, 977, 988, 989, 990, 991, 992, 993, 999, 1000, 1010, 1242, 922, 924, 929, 931, 935, 937, 941, 943, 947, 949, 951, 952, 958, 959, 960, 961, 962, 963, 964, 1012, 1013, 1014, 1015, 1016, 1018, 1020, 1022, 1023, 1025, 1027, 1028, 1030, 1031, 1033, 1035, 1037, 1039, 1041, 1045, 1048, 1050, 1051, 1053, 1055, 1056, 1058, 1061, 1062, 1064, 1066, 1068, 1071, 1073, 1075, 1077, 1079, 1080, 1082, 1084, 1086, 1088, 1090, 1092, 1093, 1094, 1096, 1098, 1100, 1102, 1104, 1106, 1108, 1110, 1112, 1113, 1114, 1116, 1117, 1118, 1119, 1121, 1123, 1125, 1292, 63, 73, 96, 127, 139, 179, 180, 209, 467, 559, 648, 726, 741, 765, 773, 781, 827, 829, 840, 841, 842, 843, 844, 845, 849, 850, 851, 852, 853, 854, 861, 865, 867, 896, 916, 926, 932, 933, 1043, 1046, 1059, 1069, 1129, 1130, 1131, 1132, 1133, 1134, 1135, 1136, 1137, 1138, 1140, 1142, 1144, 1146, 1148, 1150, 1151, 1152, 1153, 1154, 1156, 1157, 1158, 1159, 1160, 1161, 1162, 1164, 1166, 1168, 1170, 1172, 1174, 1175, 1177, 1179, 1181, 1182, 1184, 1186, 1294, 1311, 1313, 1315, 1317, 1319, 1321, 1323, 1324, 1325, 1326, 1327, 1329, 1331, 1333, 1334, 1336, 1338, 1340, 1342, 1343, 1345, 1347, 1349, 1350, 1351, 1353, 1354, 1356, 1358, 1360, or 1361. A plant produced from the plant cell has a difference in drought tolerance as compared to a control plant that does not comprise the exogenous nucleic acid.

In another aspect, a method of modulating drought tolerance comprises introducing into a plant cell an exogenous nucleic acid, that comprises a regulatory region operably linked to a nucleotide sequence having 80 percent or greater sequence identity to a nucleotide sequence set forth in SEQ ID NO: 923, 994, 905, 921, 804, 837, 828, 930, 996, 928, 868, 645, 641, 695, 505, 1067, 501, 466, 718, 860, 503, 624, 628, 630, 639, 686, 806, 479, 764, 1060, 1052, 1120, 1105, 546, 780, 460, 814, 800, 499, 643, 670, 679, 1253, 927, 716, 1081, 128, 585, 581, 864, 1049, 1107, 523, 1076, 652, 1095, 1099, 1101, 497, 830, 507, 622, 140, 772, 532, 542, 549, 226, 1149, 210, 587, 583, 866, 527, 1097, 1103, 1141, 1019, 486, 1229, 1249, 739, 697, 701, 1011, 563, 1122, 1243, 1208, 1247, 1009, 1124, 699, 1206, 72, 565, 1245, 1021, 1008, 942, 948, 818, 794, 967, 986, 786, 936, 940, 984, 855, 946, 982, 1291, 919, 822, 824, 907, 750, 909, 934, 903, 826, 95, 965, 950, 611, 575, 1190, 484, 454, 1036, 722, 444, 456, 1192, 1034, 720, 831, 911, 838, 917, 468, 1257, 659, 1173, 1139, 1176, 938, 1063, 1032, 862, 758, 450, 509, 554, 1259, 458, 1217, 972, 477, 462, 954, 1163, 956, 525, 556, 1145, 1165, 1065, 677, 609, 762, 537, 1169, 884, 1198, 1085, 1109, 1211, 1029, 689, 1070, 1233, 770, 1047, 1194, 551, 446, 633, 1167, 1078, 1213, 730, 448, 766, 895, 511, 925, 495, 1239, 1235, 1057, 1074, 1202, 544, 1083, 1024, 1220, 1224, 1200, 613, 683, 672, 976, 517, 1227, 471, 1255, 1237, 473, 728, 521, 464, 1241, 1155, 681, 736, 539, 1017, 513, 835, 657, 534, 1044, 649, 1026, 560, 1171, 579, 1038, 529, 1091, 1147, 637, 452, 1072, 1180, 833, 1040, 1089, 482, 493, 732, 1115, 626, 899, 606, 1178, 1087, 1042, 1111, 577, 1251, 475, 858, 724, 1183, 693, 1143, 1185, 1054, 1187, 571, 713, 847, 1196, 573, 1204, 601, 441, 488, 567, 589, 703, 704, 710, 1260, 1126, 1127, 1128, 1295, 802, 1303, 1297, 1301, 1299, 820, 1312, 1314, 1316, 1318, 1320, 1322, 1328, 1330, 1332, 1335, 1337, 1339, 1341, 1344, 1346, 1348, 1352, 1355, 1357, 1359 or 1362, or a fragment thereof. A plant produced from the plant cell has a difference in drought tolerance as compared to a control plant that does not comprise the exogenous nucleic acid.

Methods of modulating heat in a plant are provided herein. In one aspect, a method comprises introducing into a plant cell an exogenous nucleic acid, that comprises a regulatory region operably linked to a nucleotide sequence encoding a polypeptide. The HMM bit score of the amino acid sequence of the polypeptide is greater than about 20, using an HMM generated from the amino acid sequences depicted in one of FIGS. 10-14. A plant produced from the plant cell has a difference in heat tolerance as compared to a control plant that does not comprise the exogenous nucleic acid.

In another aspect, a method of modulating heat tolerance comprises introducing into a plant cell an exogenous nucleic acid that comprises a regulatory region operably linked to a nucleotide sequence encoding a polypeptide having 80 percent or greater sequence identity to an amino acid sequence set forth in SEQ ID NO: 60, 62, 64, 65, 66, 67, 68, 69, 70, 71, 74, 76, 78, 80, 82, 84, 86, 88, 90, 92, 94, 98, 100, 102, 104, 106, 108, 110, 112, 114, 116, 118, 120, 122, 124, 126, 130, 132, 134, 136, 138, 142, 144, 146, 148, 150, 152, 154, 156, 158, 915, 364, 366, 368, 369, 370, 371, 373, 375, 377, 379, 381, 383, 385, 387, 389, 390, 392, 394, 396, 398, 400, 401, 402, 404, 405, 407, 408, 410, 412, 413, 414, 416, 418, 419, 420, 421, 422, 423, 424, 426, 428, 430, 431, 432, 433, 434, 435, 436, 438, 440, 753, 754, 755, 756, 760, 768, 769, 774, 775, 777, 779, 783, 785, 789, 791, 793, 945, 1293, 311, 312, 314, 315, 316, 317, 319, 320, 321, 322, 323, 325, 326, 327, 329, 330, 332, 334, 335, 336, 337, 338, 339, 340, 341, 343, 344, 346, 348, 349, 350, 351, 353, 355, 356, 358, 360, 362, 876, 878, 880, 882, 886, 887, 888, 889, 890, 891, 893, 894, 897, 898, 901, 160, 162, 164, 166, 168, 170, 172, 174, 176, 178, 182, 184, 186, 188, 190, 192, 194, 196, 198, 200, 202, 204, 206, 208, 212, 214, 216, 218, 220, 222, 224, 225, 228, 229, 231, 233, 234, 235, 237, 239, 240, 242, 244, 246, 248, 250, 252, 253, 254, 256, 258, 260, 262, 264, 266, 268, 269, 271, 273, 275, 277, 279, 280, 282, 284, 286, 288, 289, 290, 291, 292, 293, 294, 295, 296, 297, 298, 299, 300, 301, 302, 303, 304, 305, 307, 309, 998, 1001, 1003, 1005, 1007, 1188, 1262, 1264, 1265, 1267, 1269, 1271, 1273, 1274, 1276, 1277, 1279, 1281, 1283, 1285, 1286, 1287, 1288, 1290, 2, 3, 4, 5, 6, 7, 8, 9, 10, 11, 13, 15, 17, 19, 21, 23, 25, 27, 29, 31, 33, 35, 37, 39, 41, 43, 45, 47, 49, 51, 53, 55, 902, 904, 906, 908, 910, 913, 914, or 920. A plant produced from the plant cell has a difference in heat tolerance as compared to a control plant that does not comprise the exogenous nucleic acid.

In another aspect, a method of modulating heat tolerance comprises introducing into a plant cell an exogenous nucleic acid, that comprises a regulatory region operably linked to a nucleotide sequence having 80 percent or greater sequence identity to a nucleotide sequence set forth in SEQ ID NO: 877, 1263, 790, 1261, 875, 792, 201, 354, 85, 77, 75, 415, 46, 207, 333, 203, 382, 83, 411, 81, 425, 406, 189, 93, 223, 44, 345, 79, 199, 417, 42, 219, 352, 185, 193, 89, 205, 386, 365, 91, 211, 195, 217, 429, 213, 187, 221, 359, 40, 197, 357, 331, 215, 183, 191, 367, 318, 87, 378, 48, 157, 155, 306, 361, 439, 52, 50, 437, 308, 54, 153, 1002, 782, 1266, 1268, 1275, 881, 784, 1278, 1280, 1004, 778, 879, 1282, 1006, 1289, 1284, 1270, 788, 883, 1272, 776, 135, 259, 109, 245, 121, 28, 115, 261, 151, 145, 328, 313, 24, 20, 391, 99, 409, 272, 1, 342, 347, 374, 131, 372, 111, 103, 107, 388, 125, 117, 18, 380, 123, 129, 26, 399, 143, 283, 30, 167, 403, 287, 137, 281, 169, 161, 14, 165, 181, 12, 38, 163, 173, 324, 177, 34, 97, 175, 171, 101, 285, 36, 276, 274, 232, 56, 270, 376, 278, 58, 59, 16, 230, 141, 32, 267, 227, 159, 241, 133, 249, 397, 247, 263, 149, 393, 395, 257, 243, 251, 113, 265, 119, 384, 427, 147, 255, 61, 22, 238, 236, 105, 310, or 363, or a fragment thereof. A plant produced from the plant cell has a difference in heat tolerance as compared to a control plant that does not comprise the exogenous nucleic acid.

Plant cells comprising an exogenous nucleic acid are provided herein. In one aspect, the exogenous nucleic acid comprises a regulatory region operably linked to a nucleotide sequence encoding a polypeptide. The HMM bit score of the amino acid sequence of the polypeptide is greater than about 20, using an HMM based on the amino acid sequences depicted in one of FIGS. 1-16. A plant produced from the cells has a difference in drought tolerance or heat tolerance as compared to a control plant that does not comprise the exogenous nucleic acid. In another aspect, the exogenous nucleic acid comprises a regulatory region operably linked to a nucleotide sequence encoding a polypeptide having 80 percent or greater sequence identity to an amino acid sequence selected from the group consisting of SEQ ID NO: 2, 3, 4, 5, 6, 7, 8, 9, 10, 11, 13, 15, 17, 19, 21, 23, 25, 27, 29, 31, 33, 35, 37, 39, 41, 43, 45, 47, 49, 51, 53, 55, 57, 60, 62, 63, 64, 65, 66, 67, 68, 69, 70, 71, 73, 74, 76, 78, 80, 82, 84, 86, 88, 90, 92, 94, 96, 98, 100, 102, 104, 106, 108, 110, 112, 114, 116, 118, 120, 122, 124, 126, 127, 130, 132, 134, 136, 138, 139, 142, 144, 146, 148, 150, 152, 154, 156, 158, 160, 162, 164, 166, 168, 170, 172, 174, 176, 178, 179, 180, 182, 184, 186, 188, 190, 192, 194, 196, 198, 200, 202, 204, 206, 208, 209, 212, 214, 216, 218, 220, 222, 224, 225, 228, 229, 231, 233, 234, 235, 237, 239, 240, 242, 244, 246, 248, 250, 252, 253, 254, 256, 258, 260, 262, 264, 266, 268, 269, 271, 273, 275, 277, 279, 280, 282, 284, 286, 288, 289, 290, 291, 292, 293, 294, 295, 296, 297, 298, 299, 300, 301, 302, 303, 304, 305, 307, 309, 311, 312, 314, 315, 316, 317, 319, 320, 321, 322, 323, 325, 326, 327, 329, 330, 332, 334, 335, 336, 337, 338, 339, 340, 341, 343, 344, 346, 348, 349, 350, 351, 353, 355, 356, 358, 360, 362, 364, 366, 368, 369, 370, 371, 373, 375, 377, 379, 381, 383, 385, 387, 389, 390, 392, 394, 396, 398, 400, 401, 402, 404, 405, 407, 408, 410, 412, 413, 414, 416, 418, 419, 420, 421, 422, 423, 424, 426, 428, 430, 431, 432, 433, 434, 435, 436, 438, 440, 442, 443, 445, 447, 449, 451, 453, 455, 457, 459, 461, 463, 465, 467, 469, 470, 472, 474, 476, 478, 480, 481, 483, 485, 487, 489, 490, 491, 492, 494, 496, 498, 500, 502, 504, 506, 508, 510, 512, 514, 515, 516, 518, 519, 520, 522, 524, 526, 528, 530, 531, 533, 535, 536, 538, 540, 541, 543, 545, 547, 548, 550, 552, 553, 555, 557, 558, 559, 561, 562, 564, 566, 568, 569, 570, 572, 574, 576, 578, 580, 582, 584, 586, 588, 590, 591, 592, 593, 594, 595, 596, 597, 598, 599, 600, 602, 603, 604, 605, 607, 608, 610, 612, 614, 615, 616, 617, 618, 619, 620, 621, 623, 625, 627, 629, 631, 632, 634, 635, 636, 638, 640, 642, 644, 646, 647, 648, 650, 651, 653, 654, 655, 656, 658, 660, 661, 662, 663, 664, 665, 666, 667, 668, 669, 671, 673, 674, 675, 676, 678, 680, 682, 684, 685, 687, 688, 690, 691, 692, 694, 696, 698, 700, 702, 705, 706, 707, 708, 709, 711, 712, 714, 715, 717, 719, 721, 723, 725, 726, 727, 729, 731, 733, 734, 735, 737, 738, 740, 741, 742, 743, 744, 745, 746, 747, 748, 749, 751, 752, 753, 754, 755, 756, 757, 759, 760, 761, 763, 765, 767, 768, 769, 771, 773, 774, 775, 777, 779, 781, 783, 785, 787, 789, 791, 793, 795, 796, 797, 798, 799, 801, 803, 805, 807, 808, 809, 810, 811, 812, 813, 815, 816, 817, 819, 821, 823, 825, 827, 829, 832, 834, 836, 839, 840, 841, 842, 843, 844, 845, 846, 848, 849, 850, 851, 852, 853, 854, 856, 857, 859, 861, 863, 865, 867, 869, 870, 871, 872, 873, 874, 876, 878, 880, 882, 885, 886, 887, 888, 889, 890, 891, 892, 893, 894, 896, 897, 898, 900, 901, 902, 904, 906, 908, 910, 912, 913, 914, 915, 916, 918, 920, 922, 924, 926, 929, 931, 932, 933, 935, 937, 939, 941, 943, 944, 945, 947, 949, 951, 952, 953, 955, 957, 958, 959, 960, 961, 962, 963, 964, 966, 968, 969, 970, 971, 973, 974, 975, 977, 978, 979, 980, 981, 983, 985, 987, 988, 989, 990, 991, 992, 993, 995, 997, 998, 999, 1000, 1001, 1003, 1005, 1007, 1010, 1012, 1013, 1014, 1015, 1016, 1018, 1020, 1022, 1023, 1025, 1027, 1028, 1030, 1031, 1033, 1035, 1037, 1039, 1041, 1043, 1045, 1046, 1048, 1050, 1051, 1053, 1055, 1056, 1058, 1059, 1061, 1062, 1064, 1066, 1068, 1069, 1071, 1073, 1075, 1077, 1079, 1080, 1082, 1084, 1086, 1088, 1090, 1092, 1093, 1094, 1096, 1098, 1100, 1102, 1104, 1106, 1108, 1110, 1112, 1113, 1114, 1116, 1117, 1118, 1119, 1121, 1123, 1125, 1129, 1130, 1131, 1132, 1133, 1134, 1135, 1136, 1137, 1138, 1140, 1142, 1144, 1146, 1148, 1150, 1151, 1152, 1153, 1154, 1156, 1157, 1158, 1159, 1160, 1161, 1162, 1164, 1166, 1168, 1170, 1172, 1174, 1175, 1177, 1179, 1181, 1182, 1184, 1186, 1188, 1189, 1191, 1193, 1195, 1197, 1199, 1201, 1203, 1205, 1207, 1209, 1210, 1212, 1214, 1215, 1216, 1218, 1219, 1221, 1222, 1223, 1225, 1226, 1228, 1230, 1231, 1232, 1234, 1236, 1238, 1240, 1242, 1244, 1246, 1248, 1250, 1252, 1254, 1256, 1258, 1262, 1264, 1265, 1267, 1269, 1271, 1273, 1274, 1276, 1277, 1279, 1281, 1283, 1285, 1286, 1287, 1288, 1290, 1292, 1293, 1294, 1296, 1298, 1300, 1302, 1304, or 1311, 1313, 1315, 1317, 1319, 1321, 1323, 1324, 1325, 1326, 1327, 1329, 1331, 1333, 1334, 1336, 1338, 1340, 1342, 1343, 1345, 1347, 1349, 1350, 1351, 1353, 1354, 1356, 1358, 1360, or 1361. A plant produced from the plant cell has a difference in drought tolerance or heat tolerance as compared to a control plant that does not comprise the exogenous nucleic acid.

In another aspect, the exogenous nucleic acid comprises a regulatory region operably linked to a nucleotide sequence having 80 percent or greater sequence identity to a nucleotide sequence selected from the group consisting of SEQ ID NO: 1, 12, 14, 16, 18, 20, 22, 24, 26, 28, 30, 32, 34, 36, 38, 40, 42, 44, 46, 48, 50, 52, 54, 56, 58, 59, 61, 72, 75, 77, 79, 81, 83, 85, 87, 89, 91, 93, 95, 97, 99, 101, 103, 105, 107, 109, 111, 113, 115, 117, 119, 121, 123, 125, 128, 129, 131, 133, 135, 137, 140, 141, 143, 145, 147, 149, 151, 153, 155, 157, 159, 161, 163, 165, 167, 169, 171, 173, 175, 177, 181, 183, 185, 187, 189, 191, 193, 195, 197, 199, 201, 203, 205, 207, 210, 211, 213, 215, 217, 219, 221, 223, 226, 227, 230, 232, 236, 238, 241, 243, 245, 247, 249, 251, 255, 257, 259, 261, 263, 265, 267, 270, 272, 274, 276, 278, 281, 283, 285, 287, 306, 308, 310, 313, 318, 324, 328, 331, 333, 342, 345, 347, 352, 354, 357, 359, 361, 363, 365, 367, 372, 374, 376, 378, 380, 382, 384, 386, 388, 391, 393, 395, 397, 399, 403, 406, 409, 411, 415, 417, 425, 427, 429, 437, 439, 441, 444, 446, 448, 450, 452, 454, 456, 458, 460, 462, 464, 466, 468, 471, 473, 475, 477, 479, 482, 484, 486, 488, 493, 495, 497, 499, 501, 503, 505, 507, 509, 511, 513, 517, 521, 523, 525, 527, 529, 532, 534, 537, 539, 542, 544, 546, 549, 551, 554, 556, 560, 563, 565, 567, 571, 573, 575, 577, 579, 581, 583, 585, 587, 589, 601, 606, 609, 611, 613, 622, 624, 626, 628, 630, 633, 637, 639, 641, 643, 645, 649, 652, 657, 659, 670, 672, 677, 679, 681, 683, 686, 689, 693, 695, 697, 699, 701, 703, 704, 710, 713, 716, 718, 720, 722, 724, 728, 730, 732, 736, 739, 750, 758, 762, 764, 766, 770, 772, 776, 778, 780, 782, 784, 786, 788, 790, 792, 794, 800, 802, 804, 806, 814, 818, 820, 822, 824, 826, 828, 830, 831, 833, 835, 837, 838, 847, 855, 858, 860, 862, 864, 866, 868, 875, 877, 879, 881, 883, 884, 895, 899, 903, 905, 907, 909, 911, 917, 919, 921, 923, 925, 927, 928, 930, 934, 936, 938, 940, 942, 946, 948, 950, 954, 956, 965, 967, 972, 976, 982, 984, 986, 994, 996, 1002, 1004, 1006, 1008, 1009, 1011, 1017, 1019, 1021, 1024, 1026, 1029, 1032, 1034, 1036, 1038, 1040, 1042, 1044, 1047, 1049, 1052, 1054, 1057, 1060, 1063, 1065, 1067, 1070, 1072, 1074, 1076, 1078, 1081, 1083, 1085, 1087, 1089, 1091, 1095, 1097, 1099, 1101, 1103, 1105, 1107, 1109, 1111, 1115, 1120, 1122, 1124, 1126, 1127, 1128, 1139, 1141, 1143, 1145, 1147, 1149, 1155, 1163, 1165, 1167, 1169, 1171, 1173, 1176, 1178, 1180, 1183, 1185, 1187, 1190, 1192, 1194, 1196, 1198, 1200, 1202, 1204, 1206, 1208, 1211, 1213, 1217, 1220, 1224, 1227, 1229, 1233, 1235, 1237, 1239, 1241, 1243, 1245, 1247, 1249, 1251, 1253, 1255, 1257, 1259, 1260, 1261, 1263, 1266, 1268, 1270, 1272, 1275, 1278, 1280, 1282, 1284, 1289, 1291, 1295, 1297, 1299, 1301, 1303, 1312, 1314, 1316, 1318, 1320, 1322, 1328, 1330, 1332, 1335, 1337, 1339, 1341, 1344, 1346, 1348, 1352, 1355, 1357, 1359 or 1362, or a fragment thereof. A plant produced from the plant cell has a difference in drought or heat tolerance as compared to a control plant that does not comprise the exogenous nucleic acid. A transgenic plant comprising such a plant cell is also provided.

Transgenic plants of any aspect provided herein can be a member of a species selected from the group consisting of *Panicum virgatum* (switchgrass), *Sorghum bicolor* (sorghum, sudangrass), *Miscanthus giganteus* (miscanthus), *Saccharum* sp. (energycane), *Populus balsamifera* (poplar), *Zea mays* (corn), *Glycine max* (soybean), *Brassica napus* (canola), *Triticum aestivum* (wheat), *Gossypium hirsutum* (cotton), *Oryza sativa* (rice), *Helianthus annuus* (sunflower), *Medicago sativa* (alfalfa), *Beta vulgaris* (sugarbeet), or *Pennisetum glaucum* (pearl millet).

Isolated nucleic acids are also provided. In one aspect, an isolated nucleic acid comprises a nucleotide sequence having 80% or greater sequence identity to the nucleotide sequence set forth in SEQ ID NO: 1, 12, 14, 16, 18, 20, 22, 24, 26, 28, 30, 32, 34, 36, 38, 40, 42, 44, 46, 48, 50, 52, 54, 56, 58, 59, 61, 72, 75, 77, 79, 81, 83, 85, 87, 89, 91, 93, 95, 97, 99, 101, 103, 105, 107, 109, 111, 113, 115, 117, 119, 121, 123, 125, 128, 129, 131, 133, 135, 137, 140, 141, 143, 145, 147, 149, 151, 153, 155, 157, 159, 161, 163, 165, 167, 169, 171, 173, 175, 177, 181, 183, 185, 187, 189, 191, 193, 195, 197, 199, 201, 203, 205, 207, 210, 211, 213, 215, 217, 219, 221, 223, 226, 227, 230, 232, 236, 238, 241, 243, 245, 247, 249, 251, 255, 257, 259, 261, 263, 265, 267, 270, 272, 274, 276, 278, 281, 283, 285, 287, 306, 308, 310, 313, 318, 324, 328, 331, 333, 342, 345, 347, 352, 354, 357, 359, 361, 363, 365, 367, 372, 374, 376, 378, 380, 382, 384, 386, 388, 391, 393, 395, 397, 399, 403, 406, 409, 411, 415, 417, 425, 427, 429, 437, 439, 441, 444, 446, 448, 450, 452, 454, 456, 458, 460, 462, 464, 466, 468, 471, 473, 475, 477, 479, 482, 484, 486, 488, 493, 495, 497, 499, 501, 503, 505, 507, 509, 511, 513, 517, 521, 523, 525, 527, 529, 532, 534, 537, 539, 542, 544, 546, 549, 551, 554, 556, 560, 563, 565, 567, 571, 573, 575, 577, 579, 581, 583, 585, 587, 589, 601, 606, 609, 611, 613, 622, 624, 626, 628, 630, 633, 637, 639, 641, 643, 645, 649, 652, 657, 659, 670, 672, 677, 679, 681, 683, 686, 689, 693, 695, 697, 699, 701, 703, 704, 710, 713, 716, 718, 720, 722, 724, 728, 730, 732, 736, 739, 750, 758, 762, 764, 766, 770, 772, 776, 778, 780, 782, 784, 786, 788, 790, 792, 794, 800, 802, 804, 806, 814, 818, 820, 822, 824, 826, 828, 830, 831, 833, 835, 837, 838, 847, 855, 858, 860, 862, 864, 866, 868, 875, 877, 879, 881, 883, 884, 895, 899, 903, 905, 907, 909, 911, 917, 919, 921, 923, 925, 927, 928, 930, 934, 936, 938, 940, 942, 946, 948, 950, 954, 956, 965, 967, 972, 976, 982, 984, 986, 994, 996, 1002, 1004, 1006, 1008, 1009, 1011, 1017, 1019, 1021, 1024, 1026, 1029, 1032, 1034, 1036, 1038, 1040, 1042, 1044, 1047, 1049, 1052, 1054, 1057, 1060, 1063, 1065, 1067, 1070, 1072, 1074, 1076, 1078, 1081, 1083, 1085, 1087, 1089, 1091, 1095, 1097, 1099, 1101, 1103, 1105, 1107, 1109, 1111, 1115, 1120, 1122, 1124, 1126, 1127, 1128, 1139, 1141, 1143, 1145, 1147, 1149, 1155, 1163, 1165, 1167, 1169, 1171, 1173, 1176, 1178, 1180, 1183, 1185, 1187, 1190, 1192, 1194, 1196, 1198, 1200, 1202, 1204, 1206, 1208, 1211, 1213, 1217, 1220, 1224, 1227, 1229, 1233, 1235, 1237, 1239, 1241, 1243, 1245, 1247, 1249, 1251, 1253, 1255, 1257, 1259, 1260, 1261, 1263, 1266, 1268, 1270, 1272, 1275, 1278, 1280, 1282, 1284, 1289, 1291, 1295, 1297, 1299, 1301, 1303, 1312, 1314, 1316, 1318, 1320, 1322, 1328, 1330, 1332, 1335, 1337, 1339, 1341, 1344, 1346, 1348, 1352, 1355, 1357, 1359 or 1362, or a fragment thereof.

In another aspect, an isolated nucleic acid comprises a nucleotide sequence encoding a polypeptide having 80% or greater sequence identity to the amino acid sequence set forth in SEQ ID NO: 2, 3, 4, 5, 6, 7, 8, 9, 10, 11, 13, 15, 17, 19, 21, 23, 25, 27, 29, 31, 33, 35, 37, 39, 41, 43, 45, 47, 49, 51, 53, 55, 57, 60, 62, 63, 64, 65, 66, 67, 68, 69, 70, 71, 73, 74, 76, 78, 80, 82, 84, 86, 88, 90, 92, 94, 96, 98, 100, 102, 104, 106, 108, 110, 112, 114, 116, 118, 120, 122, 124, 126, 127, 130, 132, 134, 136, 138, 139, 142, 144, 146, 148, 150, 152, 154, 156, 158, 160, 162, 164, 166, 168, 170, 172, 174, 176, 178, 179, 180, 182, 184, 186, 188, 190, 192, 194, 196, 198, 200, 202, 204, 206, 208, 209, 212, 214, 216, 218, 220, 222, 224, 225, 228, 229, 231, 233, 234, 235, 237, 239, 240, 242, 244, 246, 248, 250, 252, 253, 254, 256, 258, 260, 262, 264, 266, 268, 269, 271, 273, 275, 277, 279, 280, 282, 284, 286, 288, 289, 290, 291, 292, 293, 294, 295, 296, 297, 298, 299, 300, 301, 302, 303, 304, 305, 307, 309, 311, 312, 314, 315, 316, 317, 319, 320, 321, 322, 323, 325, 326, 327, 329, 330, 332, 334, 335, 336, 337, 338, 339, 340, 341, 343, 344, 346, 348, 349, 350, 351, 353, 355, 356, 358, 360, 362, 364, 366, 368, 369, 370, 371, 373, 375, 377, 379, 381, 383, 385, 387, 389, 390, 392, 394, 396, 398, 400, 401, 402, 404, 405, 407, 408, 410, 412, 413, 414, 416, 418, 419, 420, 421, 422, 423, 424, 426, 428, 430, 431, 432, 433, 434, 435, 436, 438, 440, 442, 443, 445, 447, 449, 451, 453, 455, 457, 459, 461, 463, 465, 467, 469, 470, 472, 474, 476, 478, 480, 481, 483, 485, 487, 489, 490, 491, 492, 494, 496, 498, 500, 502, 504, 506, 508, 510, 512, 514, 515, 516, 518, 519, 520, 522, 524, 526, 528, 530, 531, 533, 535, 536, 538, 540, 541, 543, 545, 547, 548, 550, 552, 553, 555, 557, 558, 559, 561, 562, 564, 566, 568, 569, 570, 572, 574, 576, 578, 580, 582, 584, 586, 588, 590, 591, 592, 593, 594, 595, 596, 597, 598, 599, 600, 602, 603, 604, 605, 607, 608, 610, 612, 614, 615, 616, 617, 618, 619, 620, 621, 623, 625, 627, 629, 631, 632, 634, 635, 636, 638, 640, 642, 644, 646, 647, 648, 650, 651, 653, 654, 655, 656, 658, 660, 661, 662, 663, 664, 665, 666, 667, 668, 669, 671, 673, 674, 675, 676, 678, 680, 682, 684, 685, 687, 688, 690, 691, 692, 694, 696, 698, 700, 702, 705, 706, 707, 708, 709, 711, 712, 714, 715, 717, 719, 721, 723, 725, 726, 727, 729, 731, 733, 734, 735, 737, 738, 740, 741, 742, 743, 744, 745, 746, 747, 748, 749, 751, 752, 753, 754, 755, 756, 757, 759, 760, 761, 763, 765, 767, 768, 769, 771, 773, 774, 775, 777, 779, 781, 783, 785, 787, 789, 791, 793, 795, 796, 797, 798, 799, 801, 803, 805, 807, 808, 809, 810, 811, 812, 813, 815, 816, 817, 819, 821, 823, 825, 827, 829, 832, 834, 836, 839, 840, 841, 842, 843, 844, 845, 846, 848, 849, 850, 851, 852, 853, 854, 856, 857, 859, 861, 863, 865, 867, 869, 870, 871, 872, 873, 874, 876, 878, 880, 882, 885, 886, 887, 888, 889, 890, 891, 892, 893, 894, 896, 897, 898, 900, 901, 902, 904, 906, 908, 910, 912, 913, 914, 915, 916, 918, 920, 922, 924, 926, 929, 931, 932, 933, 935, 937, 939, 941, 943, 944, 945, 947, 949, 951, 952, 953, 955, 957, 958, 959, 960, 961, 962, 963, 964, 966, 968, 969, 970, 971, 973, 974, 975, 977, 978, 979, 980, 981, 983, 985, 987, 988, 989, 990, 991, 992, 993, 995, 997, 998, 999, 1000, 1001, 1003, 1005, 1007, 1010, 1012, 1013, 1014, 1015, 1016, 1018, 1020, 1022, 1023, 1025, 1027, 1028, 1030, 1031, 1033, 1035, 1037, 1039, 1041, 1043, 1045, 1046, 1048, 1050, 1051, 1053, 1055, 1056, 1058, 1059, 1061, 1062, 1064, 1066, 1068, 1069, 1071, 1073, 1075, 1077, 1079, 1080, 1082, 1084, 1086, 1088, 1090, 1092, 1093, 1094, 1096, 1098, 1100, 1102, 1104, 1106, 1108, 1110, 1112, 1113, 1114, 1116, 1117, 1118, 1119, 1121, 1123, 1125, 1129, 1130, 1131, 1132, 1133, 1134, 1135, 1136, 1137, 1138, 1140, 1142, 1144, 1146, 1148, 1150, 1151, 1152, 1153, 1154, 1156, 1157, 1158, 1159, 1160, 1161, 1162, 1164, 1166, 1168, 1170, 1172, 1174, 1175, 1177, 1179, 1181, 1182, 1184, 1186, 1188, 1189, 1191, 1193, 1195, 1197, 1199, 1201, 1203, 1205, 1207, 1209, 1210, 1212, 1214, 1215, 1216, 1218, 1219, 1221, 1222, 1223, 1225, 1226, 1228, 1230, 1231, 1232, 1234, 1236, 1238, 1240, 1242, 1244, 1246, 1248, 1250, 1252, 1254, 1256, 1258, 1262, 1264, 1265, 1267, 1269, 1271, 1273, 1274, 1276, 1277, 1279, 1281, 1283, 1285, 1286, 1287, 1288, 1290, 1292, 1293, 1294, 1296, 1298, 1300, 1302, 1304, or 1311, 1313, 1315, 1317, 1319, 1321, 1323, 1324, 1325, 1326, 1327, 1329, 1331, 1333, 1334, 1336, 1338, 1340, 1342, 1343, 1345, 1347, 1349, 1350, 1351, 1353, 1354, 1356, 1358, 1360, or 1361.

In another aspect, methods of identifying a genetic polymorphism associated with variation in drought tolerance or heat tolerance are provided. The methods include providing a population of plants, and determining whether one or more genetic polymorphisms in the population are genetically linked to the locus for a polypeptide selected from the group consisting of the polypeptides depicted in FIGS. 1-16 and functional homologs thereof. The correlation between variation in drought tolerance or heat tolerance in plants of the population and the presence of the one or more genetic polymorphisms in plants of the population is measured, thereby permitting identification of whether or not the one or more genetic polymorphisms are associated with such variation. The population can be a population of switchgrass, sorghum, sugar cane, or miscanthus plants.

In another aspect, methods of making a plant line are provided. The methods include determining whether one or more genetic polymorphisms in a population of plants is associated with the locus for a polypeptide selected from the group consisting of the polypeptides depicted in FIGS. 1-16 and functional homologs thereof; identifying one or more plants in said population in which the presence of at least one allele at the one or more genetic polymorphisms is associated with variation in drought tolerance or heat tolerance; crossing each of the one or more identified plants with itself or a different plant to produce seed; crossing at least one progeny plant grown from the seed with itself or a different plant; and repeating the crossing steps for an additional 0-5 generations to make the plant line, where at least one allele is present in the plant line. The population can be a population of switchgrass, sorghum, sugar cane, or miscanthus plants.

Unless otherwise defined, all technical and scientific terms used herein have the same meaning as commonly understood by one of ordinary skill in the art to which this invention pertains. Although methods and materials similar or equivalent to those described herein can be used to practice the invention, suitable methods and materials are described below. All publications, patent applications, patents, and other references mentioned herein are incorporated by reference in their entirety. In case of conflict, the present specification, including definitions, will control. In addition, the materials, methods, and examples are illustrative only and not intended to be limiting.

The details of one or more embodiments of the invention are set forth in the accompanying drawings and the description below. Other features, objects, and advantages of the invention will be apparent from the description and drawings, and from the claims. The word "comprising" in the claims may be replaced by "consisting essentially of" or by "consisting of," according to standard practice in patent law.

DESCRIPTION OF THE DRAWINGS

FIG. 1 is an alignment of Ceres SEEDLINE ID no. ME00029 (SEQ ID NO:442) with homologous and/or orthologous sequences, including, Public GI ID no. 72384401 (SEQ ID NO:443), Ceres CLONE ID no. 1079382 (SEQ ID NO:445), Ceres CLONE ID no. 1853461 (SEQ ID NO:447), Ceres CLONE ID no. 1626485 (SEQ ID NO:451), Ceres CLONE ID no. 1713920 (SEQ ID NO:459), Ceres CLONE ID no. 1772747 (SEQ ID NO:463), Ceres CLONE ID no. 225960 (SEQ ID NO:465), Public GI ID no. 115443807 (SEQ ID NO:470), and Ceres CLONE ID no. 569388 (SEQ ID NO:483). In all the alignment figures shown herein, a dash in an aligned sequence represents a gap, i.e., a lack of an amino acid at that position. Identical amino acids or conserved amino acid substitutions among aligned sequences are identified by boxes. FIG. 1 and the other alignment figures provided herein were generated using the program MUSCLE version 3.52.

FIG. 2 is an alignment of Ceres SEEDLINE ID no. ME00045 (SEQ ID NO:489) with homologous and/or orthologous sequences, including, Ceres CLONE ID no. 571200 (SEQ ID NO:494), Ceres CLONE ID no. 1928532 (SEQ ID NO:496), Ceres ANNOT ID no. 1490637 (SEQ ID NO:498), Ceres CLONE ID no. 295496 (SEQ ID NO:514), Public GI ID no. 115463637 (SEQ ID NO:515), and Ceres CLONE ID no. 1999444 (SEQ ID NO:518).

FIG. 3 is an alignment of Ceres SEEDLINE ID no. ME02190 (SEQ ID NO:568) with homologous and/or orthologous sequences, including Ceres CLONE ID no. 695006 (SEQ ID NO:578) and Ceres ANNOT ID no. 1527488 (SEQ ID NO:584).

FIG. 4 is an alignment of Ceres SEEDLINE ID no. ME02549 (SEQ ID NO:590) with homologous and/or orthologous sequences, including, Ceres ANNOT ID no.

1501305 (SEQ ID NO:623), Ceres CLONE ID no. 607280 (SEQ ID NO:627), Public GI ID no. 92887174 (SEQ ID NO:632), Ceres CLONE ID no. 1857162 (SEQ ID NO:634), Public GI ID no. 115477272 (SEQ ID NO:674), and Ceres CLONE ID no. 264002 (SEQ ID NO:682).

FIG. 5 is an alignment of Ceres SEEDLINE ID no. ME02865 (SEQ ID NO:705) with homologous and/or orthologous sequences, including, Public GI ID no. 79320952 (SEQ ID NO:706) and Public GI ID no. 79320957 (SEQ ID NO:707).

Figure 6:
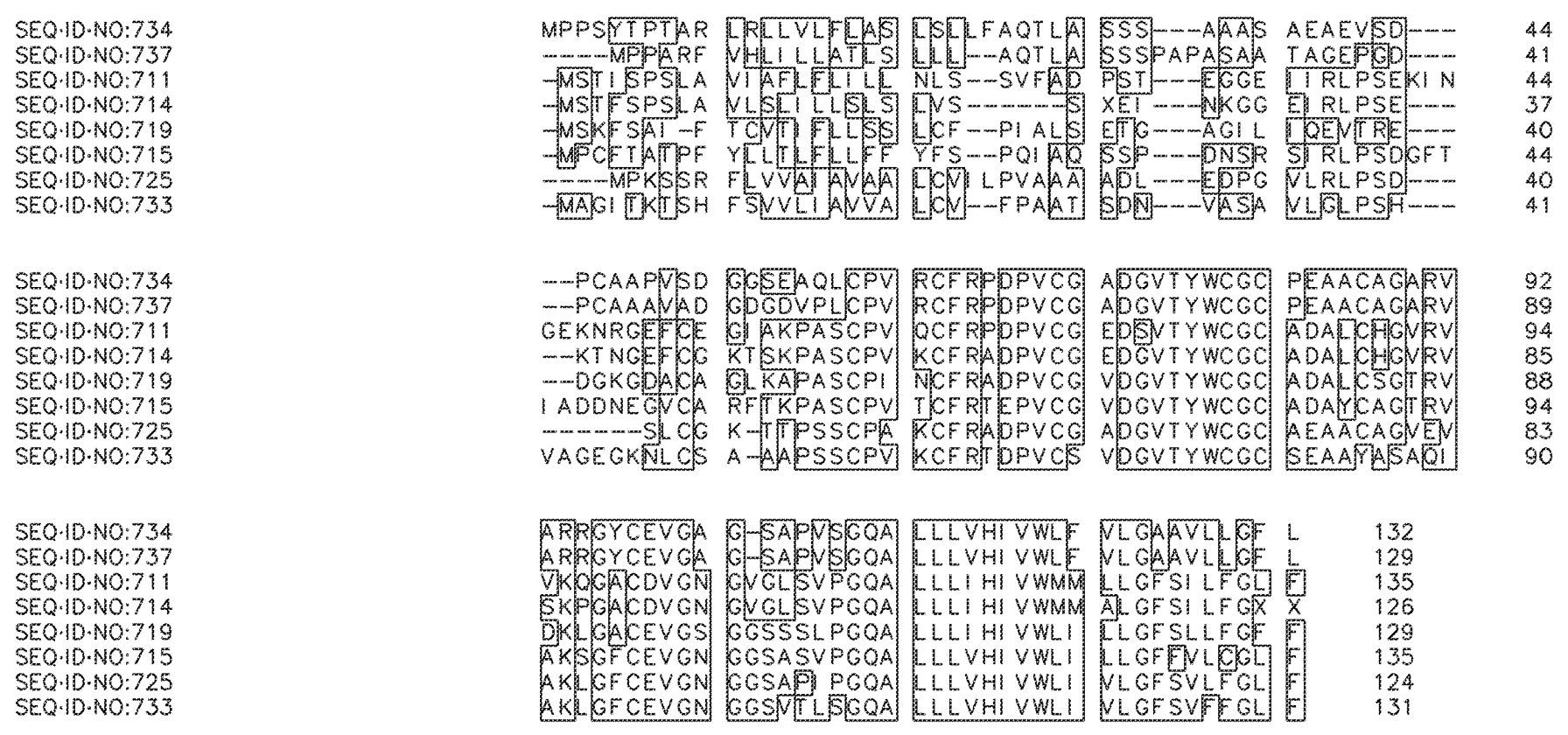

FIG. 6 is an alignment of Ceres SEEDLINE ID no. ME03227 (SEQ ID NO:711) with homologous and/or orthologous sequences, including, Ceres CLONE ID no. 964616 (SEQ ID NO:714), Ceres CLONE ID no. 100009667 (SEQ ID NO:715), Ceres ANNOT ID no. 1444568 (SEQ ID NO:719), Ceres CLONE ID no. 719489 (SEQ ID NO:725), Ceres CLONE ID no. 587748 (SEQ ID NO:733), Public GI ID no. 125528114 (SEQ ID NO:734), and Ceres CLONE ID no. 274172 (SEQ ID NO:737).

Figure 7:
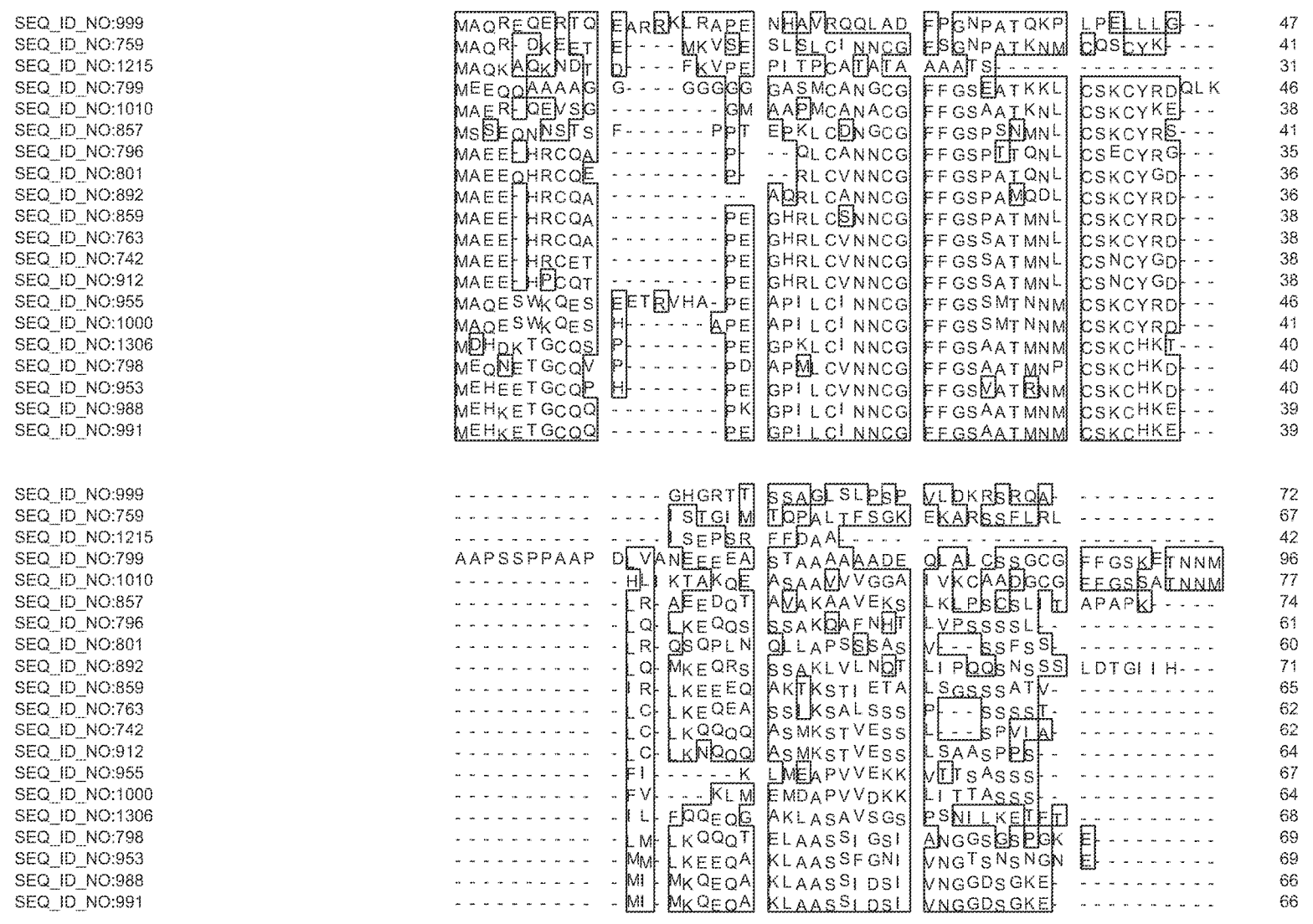
Figure 7:
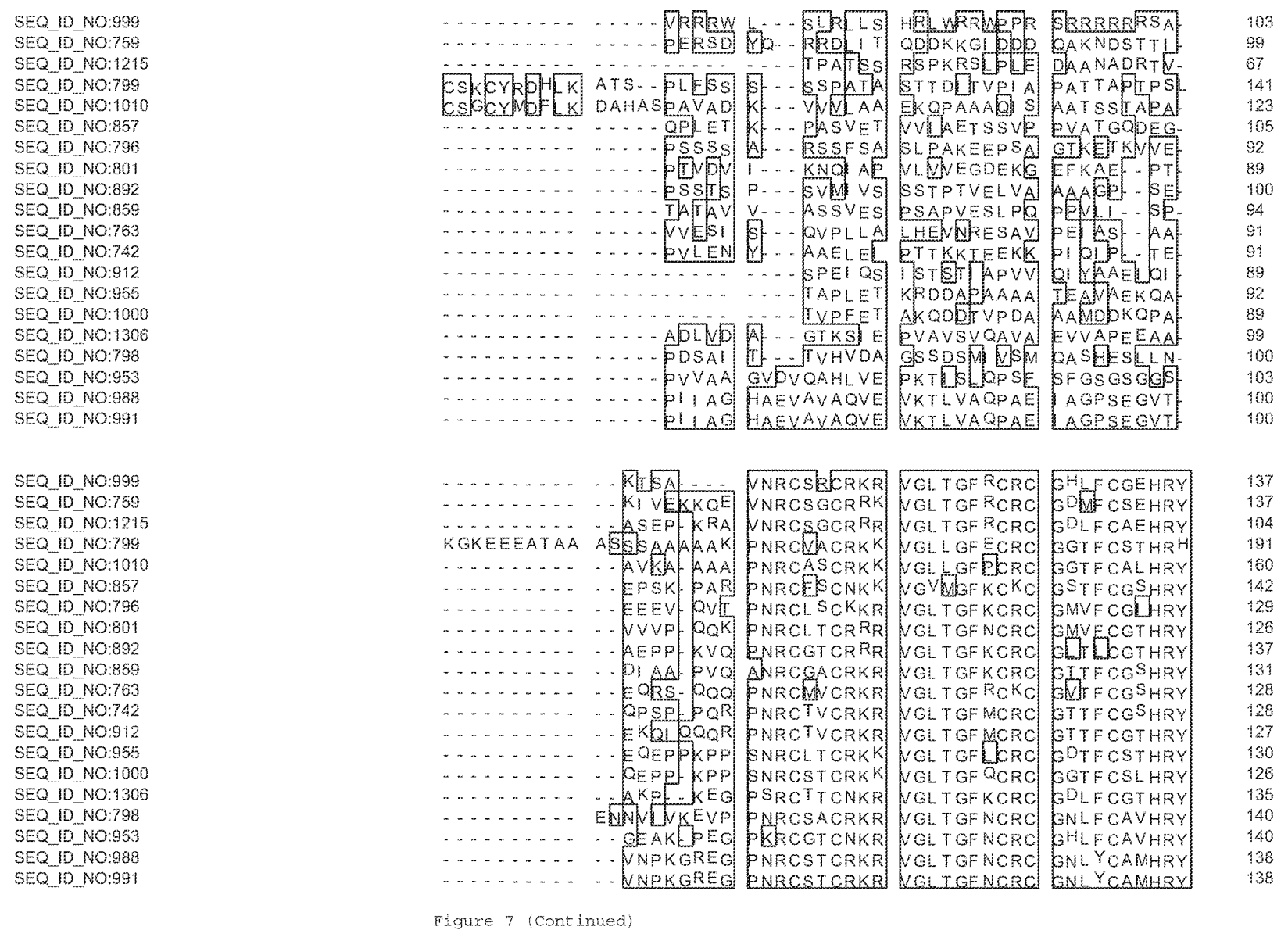

FIG. 7 is an alignment of Ceres SEEDLINE ID no. ME04477 (SEQ ID NO:742) with homologous and/or orthologous sequences, including, Ceres CLONE ID no. 1620215 (SEQ ID NO: 759); Public GI ID no. 38016527 (SEQ ID NO: 796); Ceres CLONE ID no. 1798756 (SEQ ID NO: 763); Public GI ID no. 75133829 (SEQ ID NO: 799); Ceres ANNOT ID no. 1460527 (SEQ ID NO: 801); Public GI ID no. 119720772 (SEQ ID NO: 857); Ceres CLONE ID no. 708446 (SEQ ID NO: 859); Public GI ID no. 92896423 (SEQ ID NO: 892); Ceres CLONE ID no. 1387149 (SEQ ID NO: 912); Public GI ID no. 5031281 (SEQ ID NO: 953); Ceres CLONE ID no. 1775820 (SEQ ID NO: 955); Public GI ID no. 35187687 (SEQ ID NO: 988); Public GI ID no. 115468934 (SEQ ID NO: 991); Public GI ID no. 118424243 (SEQ ID NO: 1000); Ceres ANNOT ID no. 6063957 (SEQ ID NO: 1010); CeresClone:1030374 (SEQ ID NO: 1306); Public GI ID no. 113196593 (SEQ ID NO: 798); Public GI ID no. 112819496 (SEQ ID NO: 999), and Public GI ID no. 169363 (SEQ ID NO: 1215).

Figure 8:
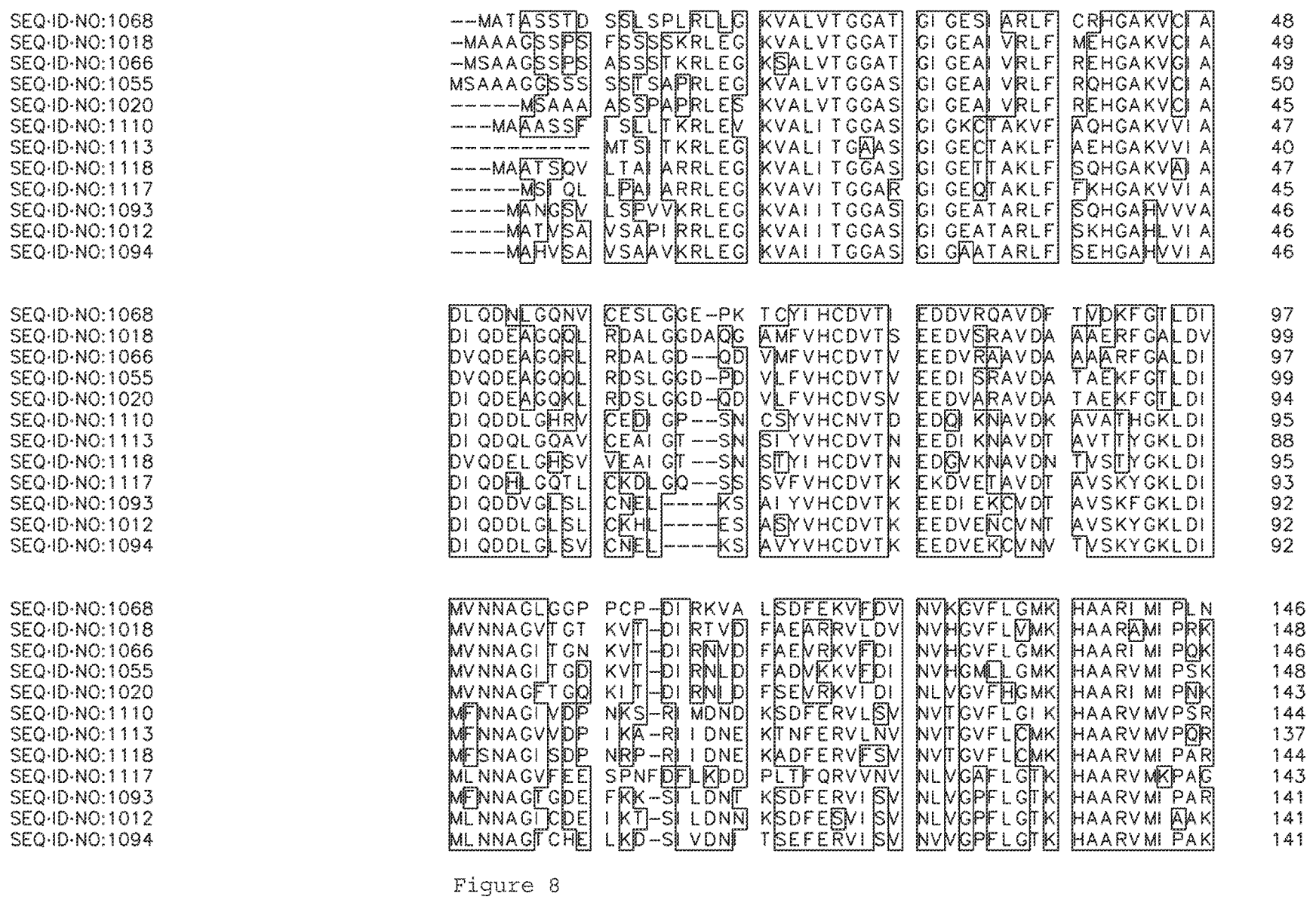
Figure 8:
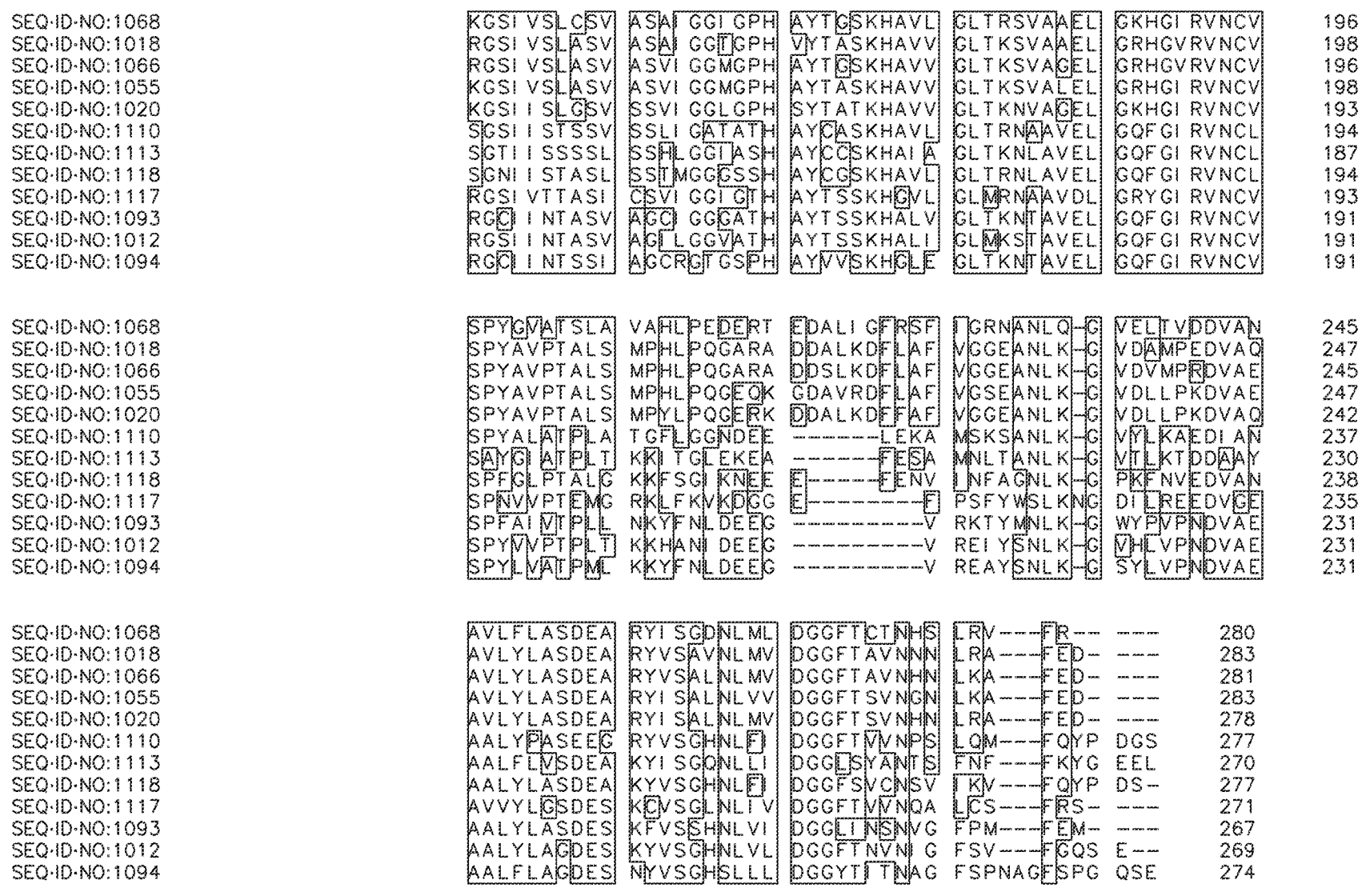

FIG. 8 is an alignment of Ceres SEEDLINE ID no. ME18396 (SEQ ID NO:1012) with homologous and/or orthologous sequences, including, Ceres CLONE ID no. 287430 (SEQ ID NO:1018), Ceres ANNOT ID no. 451889 (SEQ ID NO:1020), Ceres CLONE ID no. 936084 (SEQ ID NO:1055), Ceres CLONE ID no. 1792501 (SEQ ID NO:1066), Ceres ANNOT ID no. 1437875 (SEQ ID NO:1068), Public GI ID no. 1853968 (SEQ ID NO:1093), Public GI ID no. 27530032 (SEQ ID NO:1094), Ceres CLONE ID no. 1834483 (SEQ ID NO:1110), Public GI ID no. 84579418 (SEQ ID NO:1113), Public GI ID no. 15077030 (SEQ ID NO:1117), and Public GI ID no. 13752458 (SEQ ID NO:1118).

Figure 9:
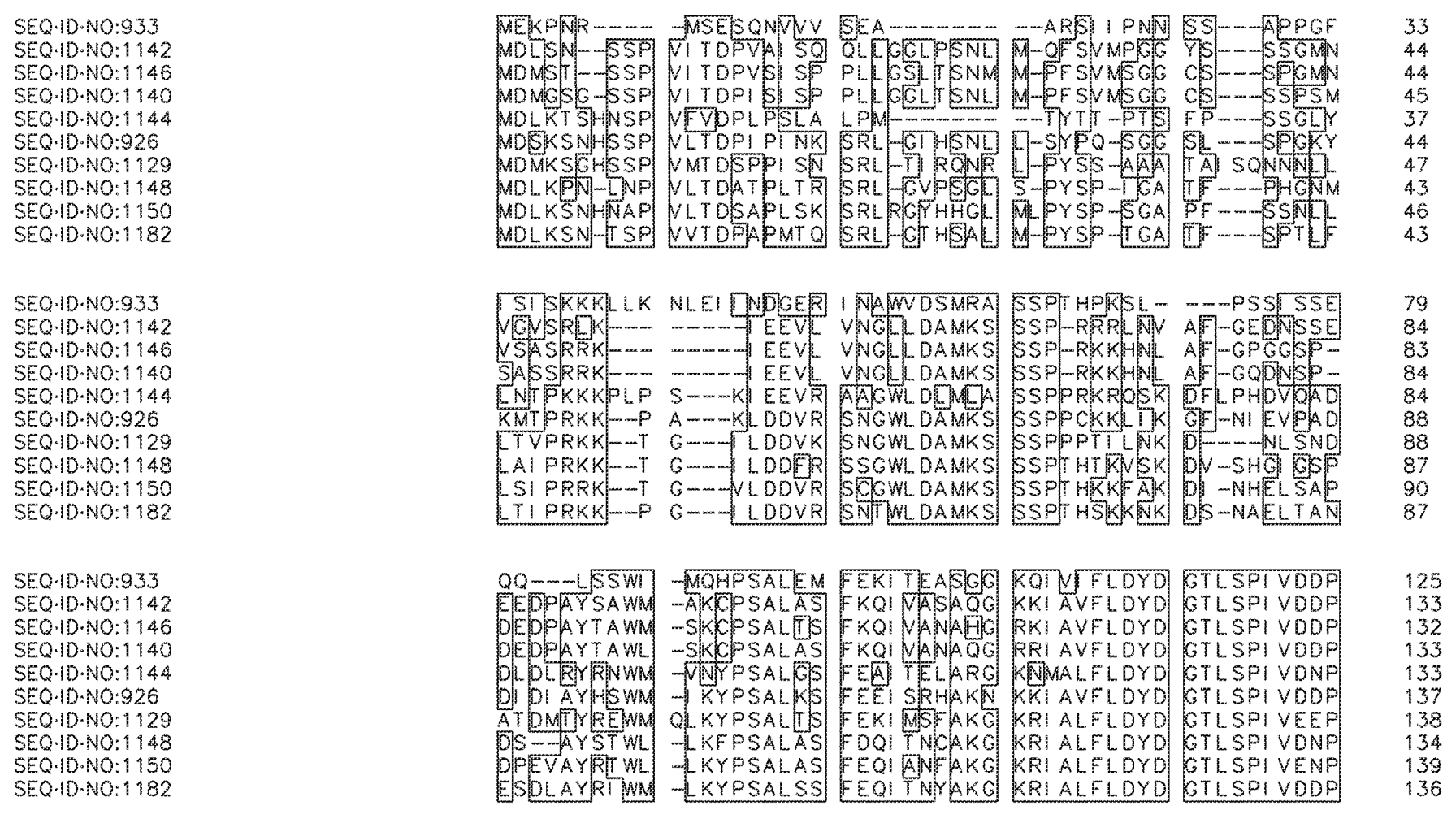

FIG. 9 is an alignment of Ceres SEEDLINE ID no. ME20095 (SEQ ID NO:1129) with homologous and/or orthologous sequences, including, Public GI ID no. 72255610 (SEQ ID NO:933), Ceres CLONE ID no. 1927040 (SEQ ID NO:926), Ceres CLONE ID no. 1562633 (SEQ ID NO:1140), Ceres ANNOT ID no. 1692728 (SEQ ID NO:1142), Ceres CLONE ID no. 921110 (SEQ ID NO:1144), Ceres CLONE ID no. 1791180 (SEQ ID NO:1146), Ceres CLONE ID no. 527891 (SEQ ID NO:1148), Ceres ANNOT ID no. 1522414 (SEQ ID NO:1150), and Public GI ID no. 51458330 (SEQ ID NO:1182).

FIG. 10 is an alignment of Ceres CLONE ID no. 31309 (SEQ ID NO:60) with homologous and/or orthologous sequences, including, Ceres CLONE ID no. 872030 (SEQ ID NO:62), Ceres CLONE ID no. 100029223 (SEQ ID NO:74), Ceres CLONE ID no. 1939845 (SEQ ID NO:98), Ceres CLONE ID no. 2015383 (SEQ ID NO:102), Ceres CLONE ID no. 1607893 (SEQ ID NO:104), Ceres CLONE ID no. 1075133 (SEQ ID NO:152), and Ceres CLONE ID no. 1218065 (SEQ ID NO:915).

Figure 11:
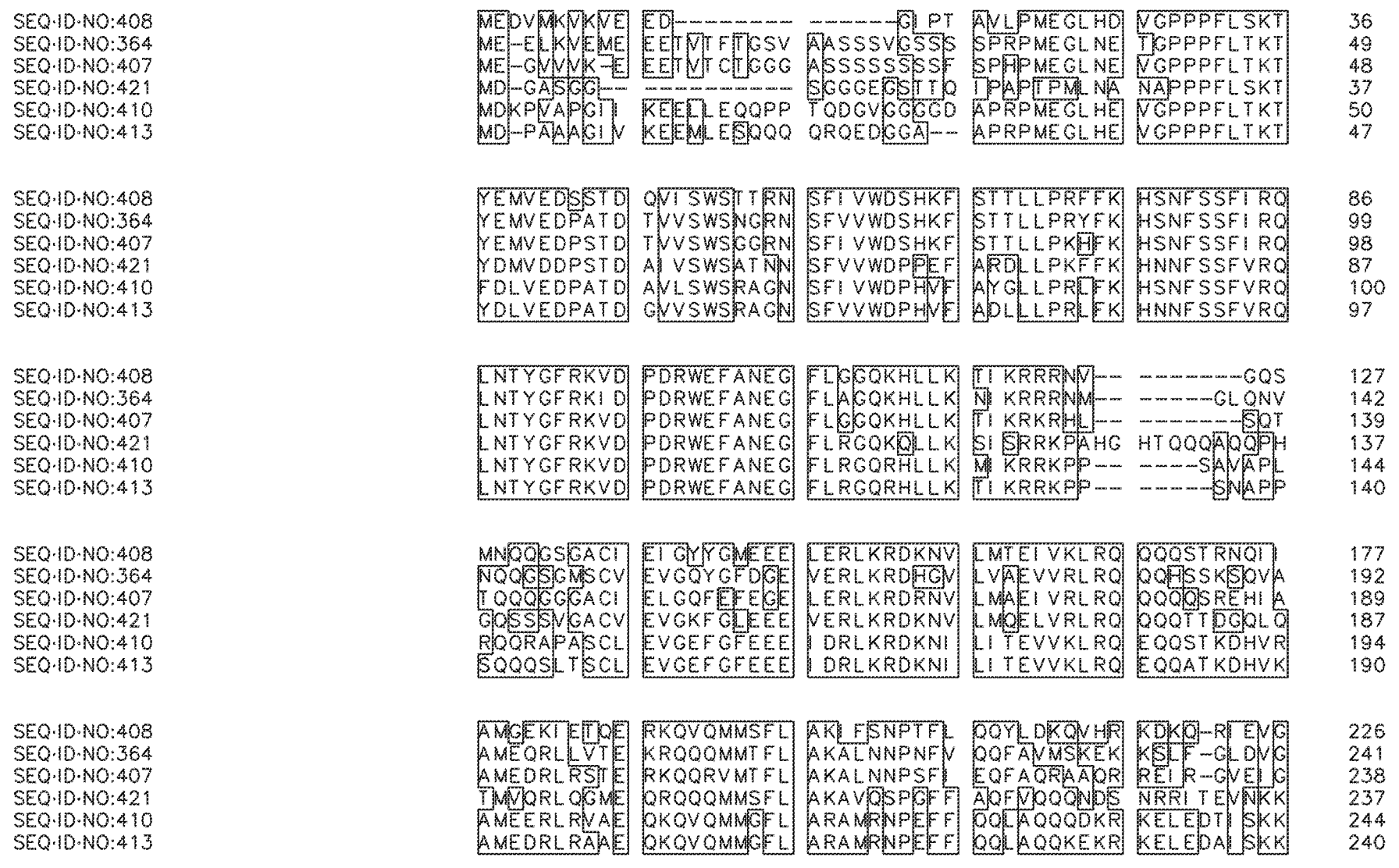
Figure 11:
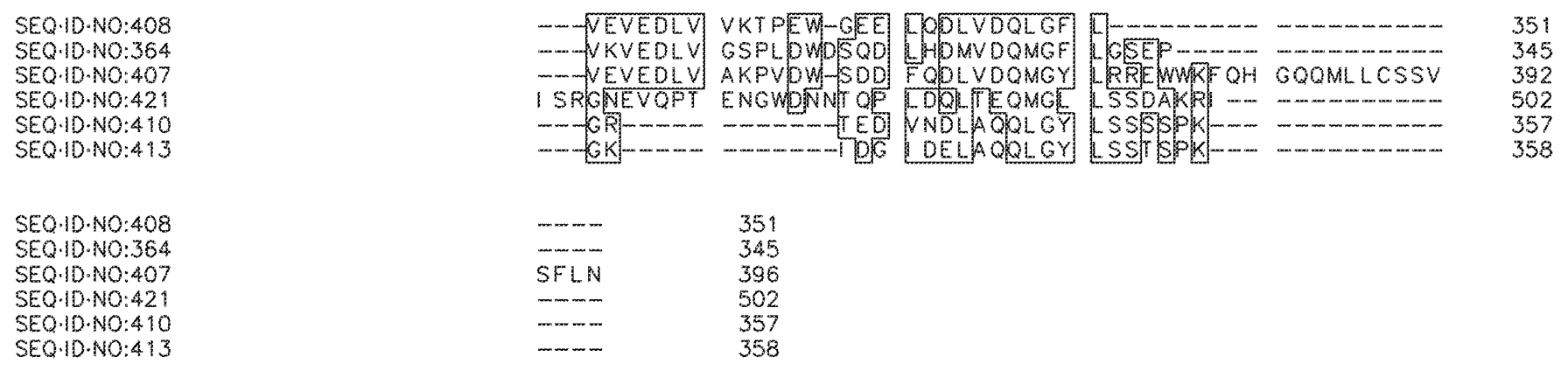

FIG. 11 is an alignment of Ceres LOCUS ID no. At2g26150 (SEQ ID NO:364) with homologous and/or orthologous sequences, including, Ceres ANNOT ID no. 1455221 (SEQ ID NO:407), Public GI ID no. 729774 (SEQ ID NO:408), Ceres CLONE ID no. 1414288 (SEQ ID NO:410), Public GI ID no. 115482048 (SEQ ID NO:413), and Public GI ID no. 56117815 (SEQ ID NO:421).

Figure 12:
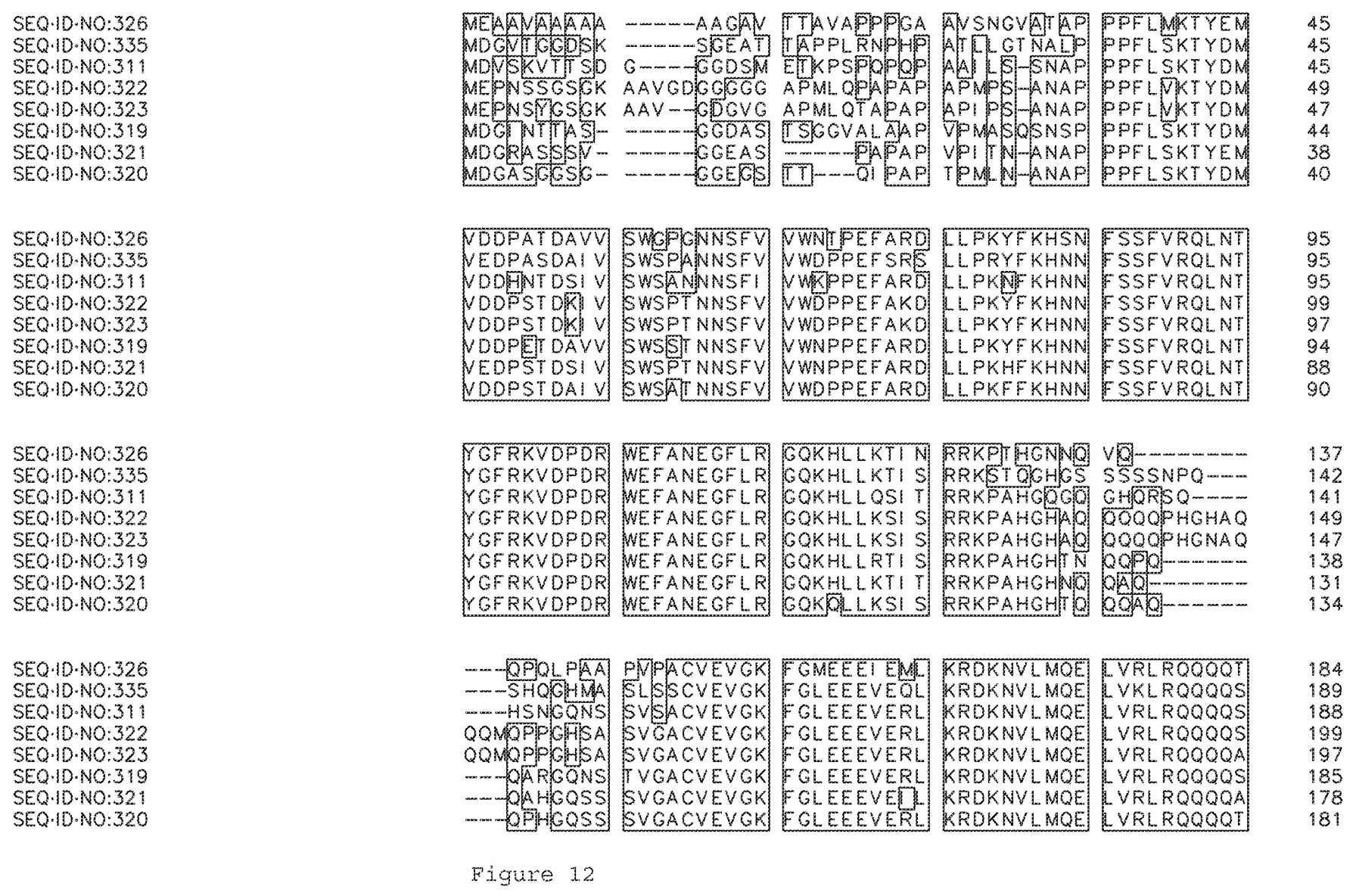
Figure 12:
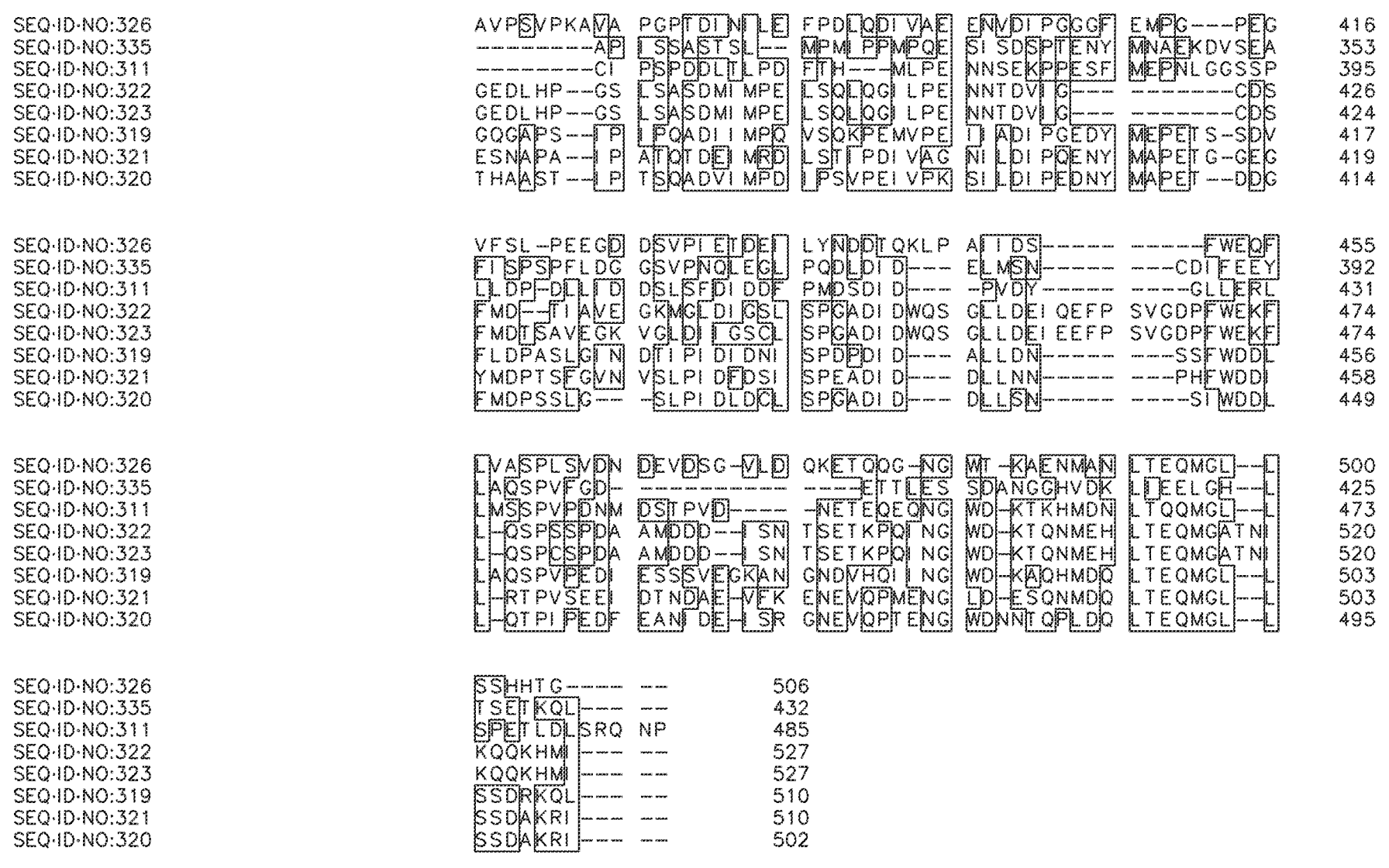

FIG. 12 is an alignment of Ceres LOCUS ID no. At1g32330 (SEQ ID NO:311) with homologous and/or orthologous sequences, including, Ceres ANNOT ID no. 1538958 (SEQ ID NO:319), Public GI ID no. 115521213 (SEQ ID NO:320), Public GI ID no. 42415865 (SEQ ID NO:321), Public GI ID no. 729775 (SEQ ID NO:322), Public GI ID no. 11386827 (SEQ ID NO:323), Public GI ID no. 115456675 (SEQ ID NO:326), and Public GI ID no. 89274218 (SEQ ID NO:335).

Figure 13:
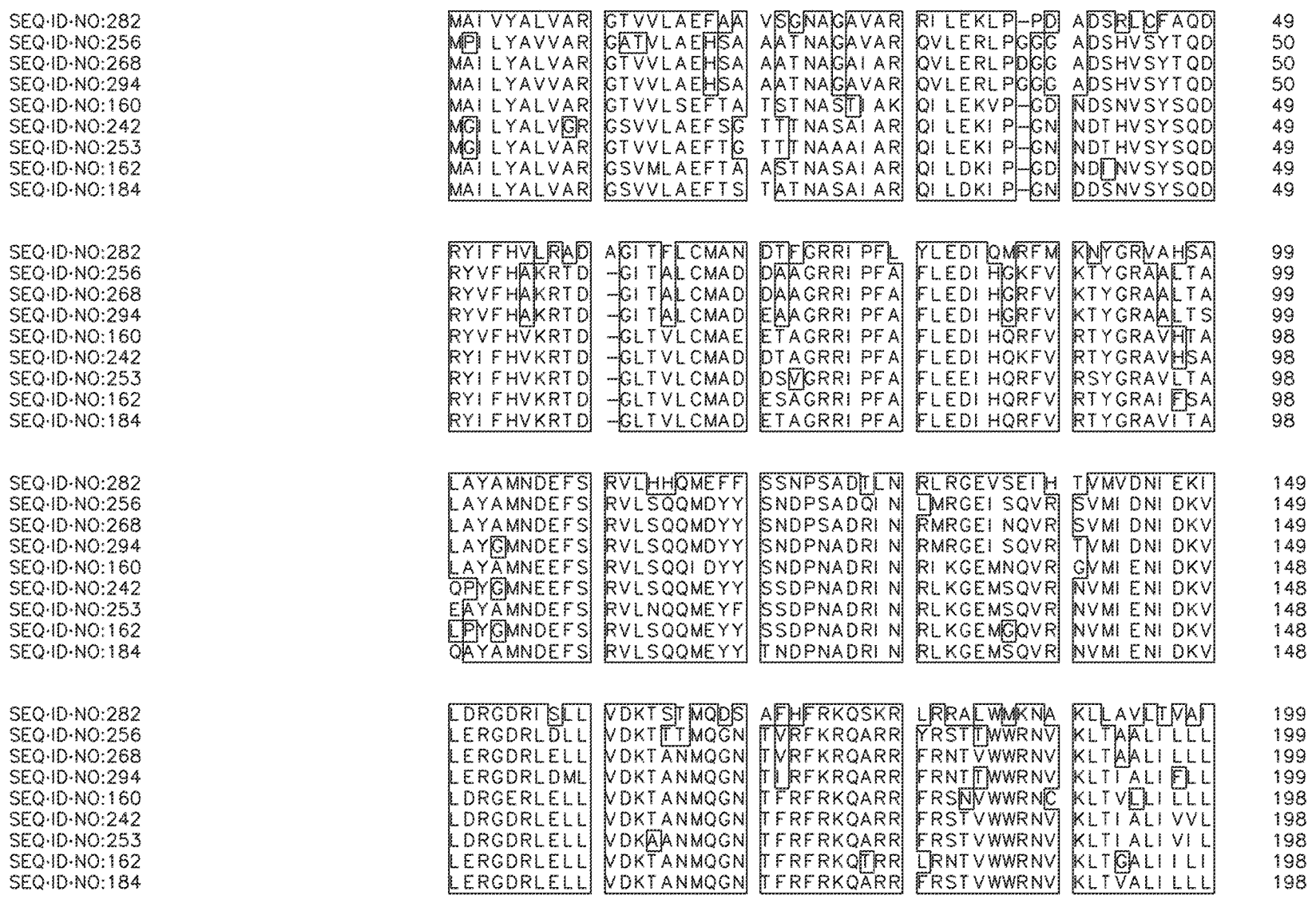

FIG. 13 is an alignment of Ceres CLONE ID no. 41543 (SEQ ID NO:160) with homologous and/or orthologous sequences, including, Ceres CLONE ID no. 1837065 (SEQ ID NO:162), Ceres ANNOT ID no. 1531178 (SEQ ID NO:184), Ceres CLONE ID no. 470694 (SEQ ID NO:242), Public GI ID no. 92867368 (SEQ ID NO:253), Ceres CLONE ID no. 859707 (SEQ ID NO:256), Ceres CLONE ID no. 392275 (SEQ ID NO:268), Ceres CLONE ID no. 1828394 (SEQ ID NO:282), and Public GI ID no. 115466694 (SEQ ID NO:294).

Figure 14:
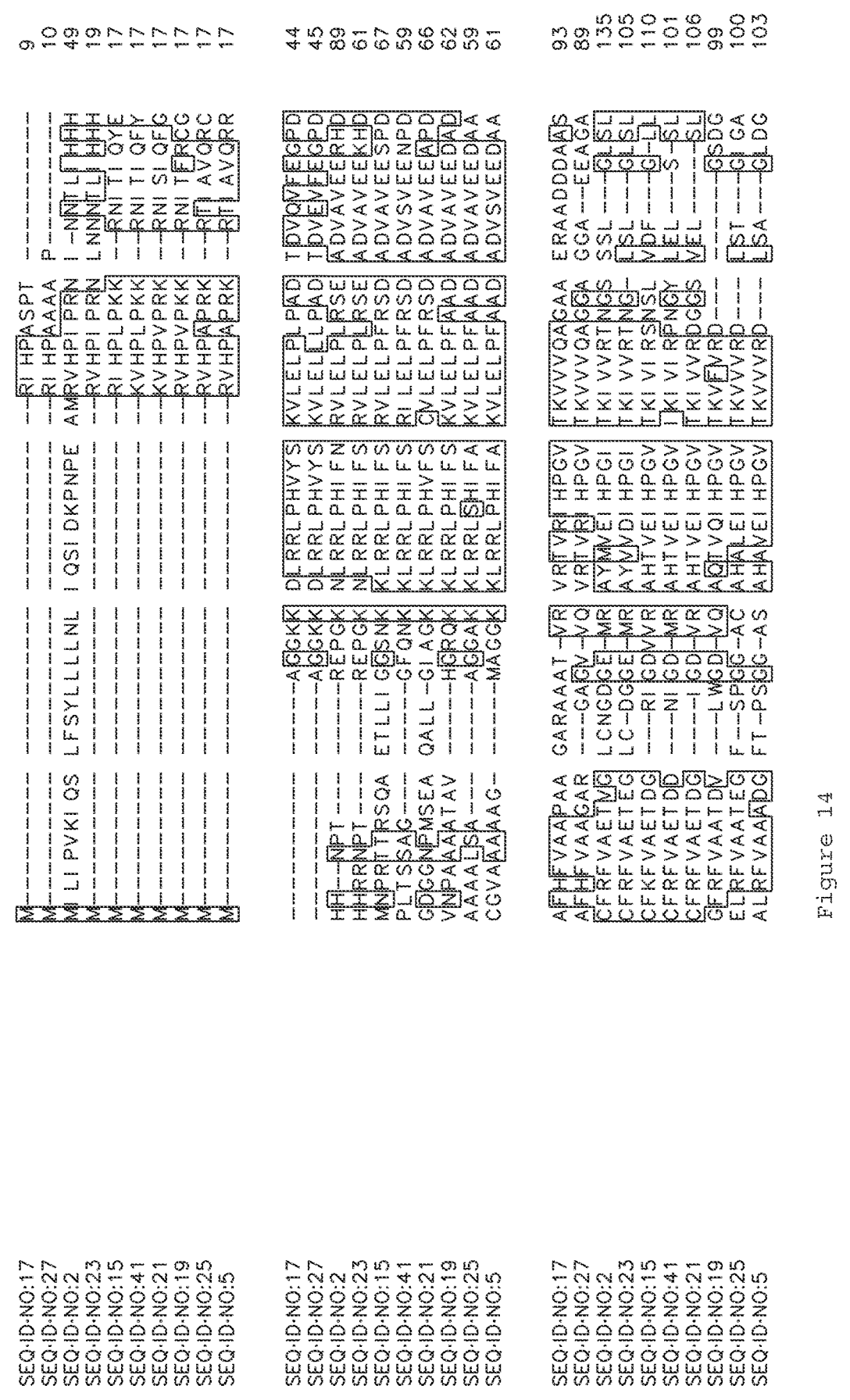
Figure 14:
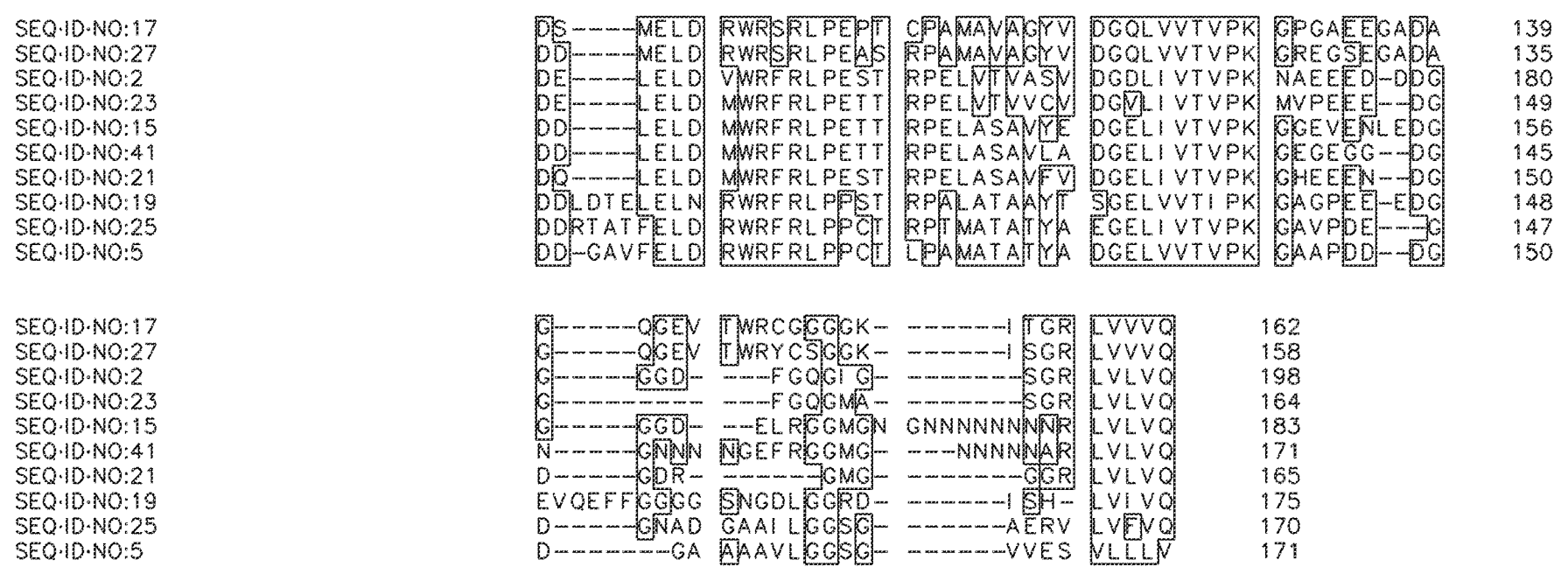

FIG. 14 is an alignment of Ceres CLONE ID no. 14572 (SEQ ID NO:2) with homologous and/or orthologous sequences, including, Public GI ID no. 115470807 (SEQ ID NO:5), Ceres CLONE ID no. 1842931 (SEQ ID NO:15), Ceres CLONE ID no. 321308 (SEQ ID NO:17), Ceres CLONE ID no. 1725811 (SEQ ID NO:19), Ceres CLONE ID no. 1357455 (SEQ ID NO:21), Ceres CLONE ID no. 943370 (SEQ ID NO:23), Ceres CLONE ID no. 1327712 (SEQ ID NO:25), Ceres CLONE ID no. 1764692 (SEQ ID NO:27), and Ceres ANNOT ID no. 1512656 (SEQ ID NO:41).

FIG. 15 is an alignment of Ceres SEEDLINE ID no. ME02401 (SEQ ID NO:749) with homologous and/or orthologous sequences, including, Ceres CLONE ID no. 1847516 (SEQ ID NO:1195), Ceres CLONE ID no. 1961986 (SEQ ID NO:1201), and Ceres ANNOT ID no. 6091930 (SEQ ID NO:1207).

FIG. 16 is an alignment of Ceres SEEDLINE ID no. ME004246 (SEQ ID NO:1311) with homologous and/or orthologous sequences, including, CeresClone:971761 (SEQ ID NO: 1313), CeresClone:1946574 (SEQ ID NO: 1331), CeresClone:2055551 (SEQ ID NO: 1340), CeresClone:100045499 (SEQ ID NO: 1347), CeresClone:1465853 (SEQ ID NO: 1353), and CeresClone:753982 (SEQ ID NO: 1360).

DETAILED DESCRIPTION

The invention features methods and materials related to increasing heat and/or drought tolerance in plants. In some embodiments, the plants may have increased heat and drought tolerance. The methods can include transforming a plant cell with a nucleic acid encoding a heat and/or drought-tolerance polypeptide, wherein expression of the polypeptide results in increased heat and/or drought tolerance. Plant cells produced using such methods can be grown to produce plants having an increased heat and/or drought tolerance. Such plants, and the seeds of such plants, may be used to produce, for example, may be used to produce biomass and/or to produce crops with increased yield and/or quality.

I. DEFINITIONS

"Amino acid" refers to one of the twenty biologically occurring amino acids and to synthetic amino acids, including D/L optical isomers.

"Cell type-preferential promoter" or "tissue-preferential promoter" refers to a promoter that drives expression preferentially in a target cell type or tissue, respectively, but may also lead to some transcription in other cell types or tissues as well.

"Control plant" refers to a plant that does not contain the exogenous nucleic acid present in a transgenic plant of interest, but otherwise has the same or similar genetic background as such a transgenic plant. A suitable control plant can be a non-transgenic wild type plant, a non-transgenic segregant from a transformation experiment, or a transgenic plant that contains an exogenous nucleic acid other than the exogenous nucleic acid of interest.

"Domains" are groups of substantially contiguous amino acids in a polypeptide that can be used to characterize protein families and/or parts of proteins. Such domains have a "fingerprint" or "signature" that can comprise conserved primary sequence, secondary structure, and/or three-dimensional conformation. Generally, domains are correlated with specific in vitro and/or in vivo activities. A domain can have a length of from 10 amino acids to 400 amino acids, e.g., 10 to 50 amino acids, or 25 to 100 amino acids, or 35 to 65 amino acids, or 35 to 55 amino acids, or 45 to 60 amino acids, or 200 to 300 amino acids, or 300 to 400 amino acids.

"Exogenous" with respect to a nucleic acid indicates that the nucleic acid is part of a recombinant nucleic acid construct, or is not in its natural environment. For example, an exogenous nucleic acid can be a sequence from one species introduced into another species, i.e., a heterologous nucleic acid. Typically, such an exogenous nucleic acid is introduced into the other species via a recombinant nucleic acid construct. An exogenous nucleic acid can also be a sequence that is native to an organism and that has been reintroduced into cells of that organism. An exogenous nucleic acid that includes a native sequence can often be distinguished from the naturally occurring sequence by the presence of non-natural sequences linked to the exogenous nucleic acid, e.g., non-native regulatory sequences flanking a native sequence in a recombinant nucleic acid construct. In addition, stably transformed exogenous nucleic acids typically are integrated at positions other than the position where the native sequence is found. It will be appreciated that an exogenous nucleic acid may have been introduced into a progenitor and not into the cell under consideration. For example, a transgenic plant containing an exogenous nucleic acid can be the progeny of a cross between a stably transformed plant and a non-transgenic plant. Such progeny are considered to contain the exogenous nucleic acid.

"Expression" refers to the process of converting genetic information of a polynucleotide into RNA through transcription, which is catalyzed by an enzyme, RNA polymerase, and into protein, through translation of mRNA on ribosomes.

"Heterologous polypeptide" as used herein refers to a polypeptide that is not a naturally occurring polypeptide in a plant cell, e.g., a transgenic *Panicum virgatum* plant transformed with and expressing the coding sequence for a nitrogen transporter polypeptide from a *Zea mays* plant.

"Isolated nucleic acid" as used herein includes a naturally-occurring nucleic acid, provided one or both of the sequences immediately flanking that nucleic acid in its naturally-occurring genome is removed or absent. Thus, an isolated nucleic acid includes, without limitation, a nucleic acid that exists as a purified molecule or a nucleic acid molecule that is incorporated into a vector or a virus. A nucleic acid existing among hundreds to millions of other nucleic acids within, for example, cDNA libraries, genomic libraries, or gel slices containing a genomic DNA restriction digest, is not to be considered an isolated nucleic acid.

"Modulation" of the level of tolerance to a stimulus (e.g., drought conditions or heat shock conditions) refers to the change in the level of tolerance of the indicated stimulus that is observed as a result of expression of, or transcription from, an exogenous nucleic acid in a plant cell. The change in level is measured relative to the corresponding level in control plants.

"Nucleic acid" and "polynucleotide" are used interchangeably herein, and refer to both RNA and DNA, including cDNA, genomic DNA, synthetic DNA, and DNA or RNA containing nucleic acid analogs. Polynucleotides can have any three-dimensional structure. A nucleic acid can be double-stranded or single-stranded (i.e., a sense strand or an antisense strand). Non-limiting examples of polynucleotides include genes, gene fragments, exons, introns, messenger RNA (mRNA), transfer RNA, ribosomal RNA, siRNA, micro-RNA, ribozymes, cDNA, recombinant polynucleotides, branched polynucleotides, nucleic acid probes and nucleic acid primers. A polynucleotide may contain unconventional or modified nucleotides.

"Operably linked" refers to the positioning of a regulatory region and a sequence to be transcribed in a nucleic acid so that the regulatory region is effective for regulating transcription or translation of the sequence. For example, to operably link a coding sequence and a regulatory region, the translation initiation site of the translational reading frame of the coding sequence is typically positioned between one and about fifty nucleotides downstream of the regulatory region. A regulatory region can, however, be positioned as much as about 5,000 nucleotides upstream of the translation initiation site, or about 2,000 nucleotides upstream of the transcription start site.

"Polypeptide" as used herein refers to a compound of two or more subunit amino acids, amino acid analogs, or other peptidomimetics, regardless of post-translational modification, e.g., phosphorylation or glycosylation. The subunits may be linked by peptide bonds or other bonds such as, for example, ester or ether bonds. Full-length polypeptides, truncated polypeptides, point mutants, insertion mutants, splice variants, chimeric proteins, and fragments thereof are encompassed by this definition.

"Progeny" includes descendants of a particular plant or plant line. Progeny of an instant plant include seeds formed on $F_1$, $F_2$, $F_3$, $F_4$, $F_5$, $F_6$ and subsequent generation plants, or seeds formed on $BC_1$, $BC_2$, $BC_3$, and subsequent generation plants, or seeds formed on $F_1BC_1$, $F_1BC_2$, $F_1BC_3$, and subsequent generation plants. The designation $F_1$ refers to the progeny of a cross between two parents that are genetically distinct. The designations $F_2$, $F_3$, $F_4$, $F_5$ and $F_6$ refer to subsequent generations of self- or sib-pollinated progeny of an $F_1$ plant.

"Regulatory region" refers to a nucleic acid having nucleotide sequences that influence transcription or translation initiation and rate, and stability and/or mobility of a transcription or translation product. Regulatory regions include, without limitation, promoter sequences, enhancer sequences, response elements, protein recognition sites, inducible elements, protein binding sequences, 5' and 3' untranslated regions (UTRs), transcriptional start sites, termination sequences, polyadenylation sequences, introns, and combinations thereof. A regulatory region typically comprises at least a core (basal) promoter. A regulatory region also may include at least one control element, such as an enhancer sequence, an upstream element or an upstream activation region (UAR). For example, a suitable enhancer is a cis-regulatory element (−212 to −154) from the upstream region of the octopine synthase (ocs) gene. Fromm et al., *The Plant Cell*, 1:977-984 (1989).

"Up-regulation" refers to regulation that increases the level of an expression product (mRNA, polypeptide, or both) relative to basal or native states.

"Vector" refers to a replicon, such as a plasmid, phage, or cosmid, into which another DNA segment may be inserted so as to bring about the replication of the inserted segment. Generally, a vector is capable of replication when associated with the proper control elements. The term "vector" includes cloning and expression vectors, as well as viral vectors and integrating vectors. An "expression vector" is a vector that includes a regulatory region.

II. POLYPEPTIDES

Polypeptides described herein include heat and/or drought-tolerance polypeptides. Heat and/or drought-tolerance polypeptides can be effective to increase heat and/or drought-tolerance when expressed in a plant or plant cell. Such polypeptides typically contain at least one domain indicative of heat and/or drought-tolerance polypeptides, as described in more detail herein. Heat and/or drought-tolerance polypeptides typically have an HMM bit score that is greater than 20 for an HMM model based on one of the alignments set forth in FIGS. 1-16, as described in more detail herein. In some embodiments, heat and/or drought-tolerance polypeptides have greater than 80% identity to SEQ ID NO:442, SEQ ID NO:489, SEQ ID NO:568, SEQ ID NO:590, SEQ ID NO:705, SEQ ID NO:711, SEQ ID NO:742, SEQ ID NO:1012, SEQ ID NO:1129, SEQ ID NO:60, SEQ ID NO:364, SEQ ID NO:311, SEQ ID NO:160, SEQ ID NO:2, SEQ ID NO:749, SEQ ID NO:1311, or SEQ ID NO:57, as described in more detail herein.

A. Domains Indicative of Heat and/or Drought-Tolerance Polypeptides

A drought-tolerance polypeptide can be a RNA polymerase Rpb4 family member. The eukaryotic RNA polymerase subunit RPB4 forms a heterodimer with subunit RPB7 that reversibly associates with the RNA polymerase II core. SEQ ID NO:442 sets forth the amino acid sequence of an *Arabidopsis* clone, identified herein as Ceres SEEDLINE ID No. ME00029 (SEQ ID NO:441), that is predicted to encode a RNA polymerase Rpb4 polypeptide.

A drought-tolerance polypeptide can contain a sulfotransferase 1 domain characteristic of polypeptides belonging to the sulfotransferase family. Members of the sulfotransferase family catalyze the transfer of sulfate groups to specific compounds. SEQ ID NO:590, which sets forth the amino acid sequence of an *Arabidopsis* clone, identified herein as Ceres SEEDLINE ID No. ME02549 (SEQ ID NO:589), is predicted to encode a polypeptide containing a sulfotransferase 1 domain.

A drought-tolerance polypeptide can contain an AN1-like zinc finger (zf-AN1) and an A20-like zinc finger (zf-A20) domain. The AN1-like zinc finger domain was first identified as a zinc finger at the C-terminus of An1, a ubiquitin-like protein in *Xenopus laevis*. The AN1-like zinc finger domain is characterized by the pattern, C-X2-C-X(9-12)-C-X(1-2)-C-X4-C-X2-H-X5-H-X-C Where X can be any amino acid, and numbers in brackets indicate the number of residues. In A20, the A20-like zinc finger domain mediates self-association and IL-1-induced NF-kappa B activation. SEQ ID NO:742, which sets forth the amino acid sequence of an *Arabidopsis* clone, identified herein as Ceres Clone ID No. 24255 (SEQ ID NO:1241), is predicted to encode a polypeptide containing an AN1-like zinc finger domain and a A20-like zinc finger domain. SEQ ID NO:749, which sets forth the amino acid sequence of an *Arabidopsis* clone, identified herein as Ceres SEEDLINE ID No. ME02401, is also predicted to encode a polypeptide containing an AN1-like zinc finger domain and a A20-like zinc finger domain.

A drought-tolerance polypeptide can contain a short chain dehydrogenase (adh_short) domain. Most polypeptides containing a short chain dehydrogenase domain are polypeptides of about 250 to 300 amino acid residues, and are NAD- or NADP-dependent oxidoreductases. SEQ ID NO:1012, which sets forth the amino acid sequence of an *Arabidopsis* clone, identified herein as Ceres SEEDLINE ID No. 18396 (SEQ ID NO:1260), is predicted to encode a polypeptide containing a short chain dehydrogenase domain.

A drought-tolerance polypeptide can contain a trehalose-phosphatase (Trehalose_PPase) domain characteristic of trehalose phosphatase polypeptides. Trehalose phosphatases catalyse the de-phosphorylation of trehalose-6-phosphate to trehalose and orthophosphate. Trehalose is a common disaccharide in bacteria, fungi, and invertebrates that appears to play a role in desiccation tolerance. SEQ ID NO:1129, which sets forth the amino acid sequence of an *Arabidopsis* clone, identified herein as Ceres SEEDLINE ID No. ME20095 (SEQ ID NO:1126), is predicted to encode a polypeptide containing a trehalose-phosphatase domain.

A heat-tolerance polypeptide can be a synaptobrevin-related polypeptide. SEQ ID NO:160, which sets forth the amino acid sequence of an *Arabidopsis* clone, identified herein as Ceres CLONE ID no. 41543 (SEQ ID NO:159), is predicted to encode a synaptobrevin-related polypeptide.

A heat-tolerance polypeptide can contain an HSF-type DNA-binding domain, which is predicted to be characteristic of heat shock factor transcription activator. Heat shock factor transcription activators are often found associated with heat shock protein promoters during heat shock. SEQ ID NO:311, which sets forth the amino acid sequence of an *Arabidopsis* clone, identified herein as Ceres LOCUS ID no. At1g32330 (SEQ ID NO:310), is predicted to encode a polypeptide containing an HSF-type DNA-binding domain. SEQ ID NO:364, which sets forth the amino acid sequence of an *Arabidopsis* clone, identified herein as Ceres LOCUS ID no. At2g26150 (SEQ ID NO:363), is also predicted to encode a polypeptide containing an HSF-type DNA-binding domain.

A heat-tolerance polypeptide can contain a DnaJ domain. The prokaryotic heat shock protein DnaJ interacts with the chaperone hsp70-like DnaK protein. Structurally, the DnaJ protein consists of an N-terminal conserved domain (called 'J' domain) of about 70 amino acids, a glycine-rich region ('G' domain') of about 30 residues, a central domain containing four repeats of a CXXCXGXG motif ('CRR' domain) (SEQ ID NO:1364) and a C-terminal region of 120 to 170 residues. SEQ ID NO:60, which sets forth the amino acid sequence of an *Arabidopsis* clone, identified herein as Ceres CLONE ID no. 31309 (SEQ ID NO:58), is predicted to encode an polypeptide containing a DnaJ domain.

A drought-tolerance polypeptide can contain a KH_2 domain. Most polypeptides containing a KH_2 domain are typically around 70 amino acids and are present in a wide variety of quite diverse nucleic acid-binding proteins. It has been shown to bind RNA. Like many other RNA-binding motifs, KH motifs are found in one or multiple copies, each motif is necessary for in vitro RNA binding activity, suggesting that they may function cooperatively or, in the case of single KH motif proteins (for example, Mer1p), independently. According to structural analysis the KH domain can be separated in two groups. The first group or type-1 contain a beta-alpha-alpha-beta-beta-alpha structure, whereas in the type-2 the two last beta-sheet are located in the N terminal part of the domain (alpha-beta-beta-alpha-alpha-beta). Sequence similarity between these two folds are limited to a short region (VIGXXGXXI, SEQ ID NO:1365) in the RNA binding motif. This motif is located between helices 1 and 2 in type-1 and between helices 2 and 3 in type-2. SEQ ID NO:1311, which sets forth the amino acid sequence of an *Arabidopsis* clone, identified herein as Ceres SEEDLINE ID No. ME04246 (SEQ ID NO:1362), is predicted to encode a polypeptide containing a KH_2 domain.

B. Functional Homologs Identified by Reciprocal BLAST

In some embodiments, one or more functional homologs of a reference heat and/or drought-tolerance polypeptide defined by one or more of the Pfam descriptions indicated above are suitable for use as heat and/or drought-tolerance polypeptides. A functional homolog is a polypeptide that has sequence similarity to a reference polypeptide, and that carries out one or more of the biochemical or physiological function(s) of the reference polypeptide. A functional homolog and the reference polypeptide may be natural occurring polypeptides, and the sequence similarity may be due to convergent or divergent evolutionary events. As such, functional homologs are sometimes designated in the literature as homologs, or orthologs, or paralogs. Variants of a naturally occurring functional homolog, such as polypeptides encoded by mutants of a wild type coding sequence, may themselves be functional homologs. Functional homologs can also be created via site-directed mutagenesis of the coding sequence for a heat and/or drought-tolerance polypeptide, or by combining domains from the coding sequences for different naturally-occurring heat and/or drought-tolerance polypeptides ("domain swapping"). The term "functional homolog" is sometimes applied to the nucleic acid that encodes a functionally homologous polypeptide.

Functional homologs can be identified by analysis of nucleotide and polypeptide sequence alignments. For example, performing a query on a database of nucleotide or polypeptide sequences can identify homologs of heat and/or drought-tolerance polypeptides. Sequence analysis can involve BLAST, Reciprocal BLAST, or PSI-BLAST analysis of nonredundant databases using a heat and/or drought-tolerance polypeptide amino acid sequence as the reference sequence. Amino acid sequence is, in some instances, deduced from the nucleotide sequence. Those polypeptides in the database that have greater than 40% sequence identity are candidates for further evaluation for suitability as a heat and/or drought-tolerance polypeptide Amino acid sequence similarity allows for conservative amino acid substitutions, such as substitution of one hydrophobic residue for another or substitution of one polar residue for another. If desired, manual inspection of such candidates can be carried out in order to narrow the number of candidates to be further evaluated. Manual inspection can be performed by selecting those candidates that appear to have domains present in heat and/or drought-tolerance polypeptides, e.g., conserved functional domains.

Conserved regions can be identified by locating a region within the primary amino acid sequence of a heat and/or drought-tolerance polypeptide that is a repeated sequence, forms some secondary structure (e.g., helices and beta sheets), establishes positively or negatively charged domains, or represents a protein motif or domain. See, e.g., the Pfam web site describing consensus sequences for a variety of protein motifs and domains on the World Wide Web at sanger.ac.uk/Software/Pfam/ and pfam.janelia.org/. A description of the information included at the Pfam database is described in Sonnhammer et al., *Nucl. Acids Res.*, 26:320-322 (1998); Sonnhammer et al., *Proteins*, 28:405-420 (1997); and Bateman et al., *Nucl. Acids Res.*, 27:260-262 (1999). Conserved regions also can be determined by aligning sequences of the same or related polypeptides from closely related species. Closely related species preferably are from the same family. In some embodiments, alignment of sequences from two different species is adequate.

Typically, polypeptides that exhibit at least about 20% amino acid sequence identity are useful to identify conserved regions. Conserved regions of related polypeptides exhibit at least 45% amino acid sequence identity (e.g., at least 50%, at least 60%, at least 70%, at least 80%, or at least 90% amino acid sequence identity). In some embodiments, a conserved region exhibits at least 92%, 94%, 96%, 98%, or 99% amino acid sequence identity.

Figure 1:
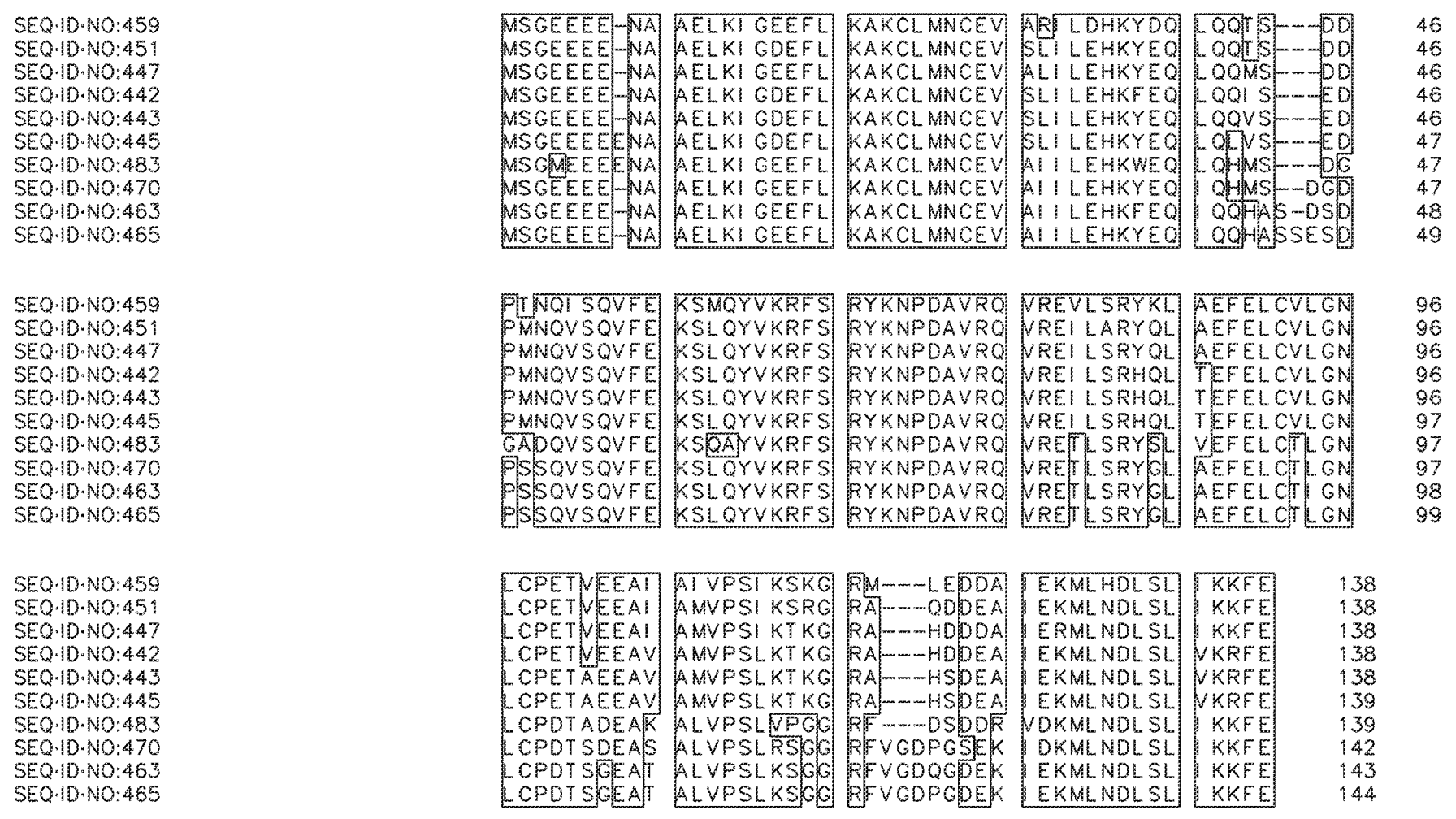

Examples of amino acid sequences of functional homologs of the polypeptide set forth in SEQ ID NO:442 are provided in FIG. 1 and in the sequence listing. Such functional homologs include Public GI ID no. 72384401 (SEQ ID NO:443), Ceres CLONE ID no. 1079382 (SEQ ID NO:445), Ceres CLONE ID no. 1853461 (SEQ ID NO:447), Ceres CLONE ID no. 1626485 (SEQ ID NO:451), Ceres CLONE ID no. 1713920 (SEQ ID NO:459), Ceres CLONE ID no. 1772747 (SEQ ID NO:463), Ceres CLONE ID no. 225960 (SEQ ID NO:465), Public GI ID no. 115443807 (SEQ ID NO:470), and Ceres CLONE ID no. 569388 (SEQ ID NO:483). Other functional homologs of SEQ ID NO:442 include Ceres CLONE ID no. 1915549 (SEQ ID NO:449), Ceres CLONE ID no. 529871 (SEQ ID NO:453), Ceres CLONE ID no. 1067079 (SEQ ID NO:455), Ceres CLONE ID no. 1079572 (SEQ ID NO:457), Ceres ANNOT ID no. 1456550 (SEQ ID NO:461), Ceres CLONE ID no. 1437889 (SEQ ID NO:469), Ceres CLONE ID no. 2014249 (SEQ ID NO:472), Ceres CLONE ID no. 2033133 (SEQ ID NO:474), Ceres CLONE ID no. 707404 (SEQ ID NO:476), Ceres CLONE ID no. 1770680 (SEQ ID NO:478), Ceres ANNOT ID no. 1450989 (SEQ ID NO:480), Public GI ID no. 72384445 (SEQ ID NO:481), Ceres CLONE ID no. 1059299 (SEQ ID NO:485), and Ceres ANNOT ID no. 6008086 (SEQ ID NO:487). In some cases, a functional homolog of SEQ ID NO:442 has an amino acid sequence with at least 40% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:442.

Figure 2:
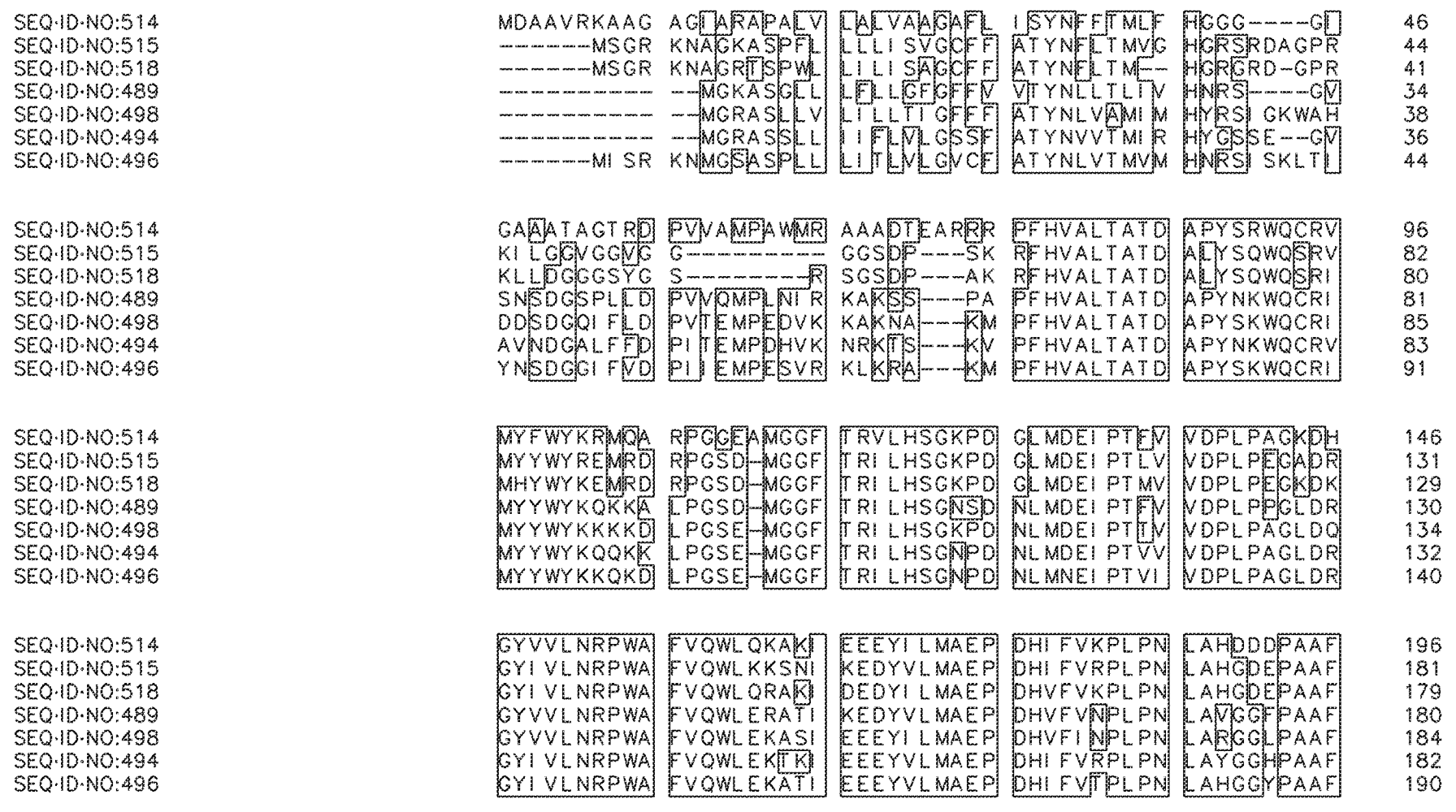
Figure 2:
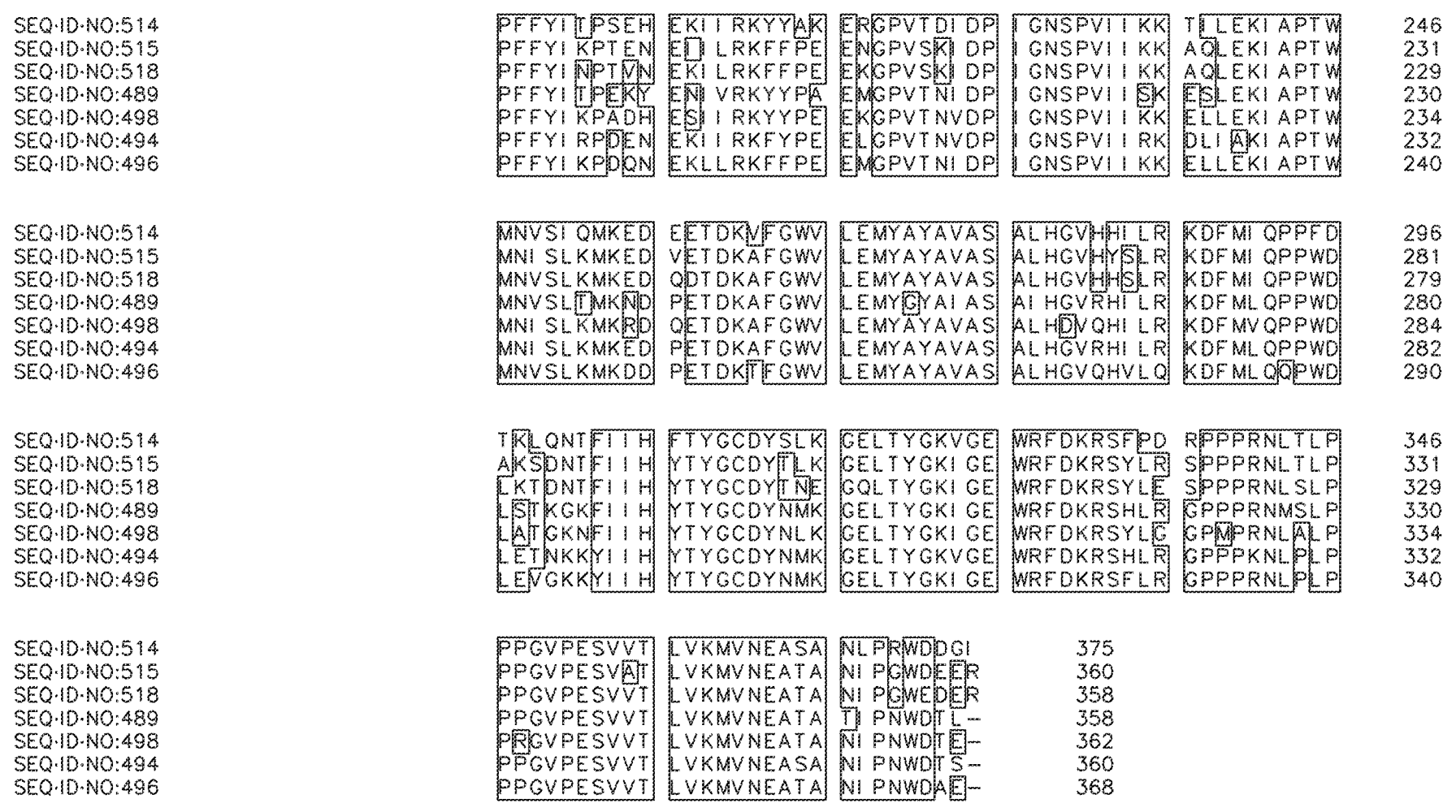

Examples of amino acid sequences of functional homologs of the polypeptide set forth in SEQ ID NO:489 are provided in FIG. 2 and in the sequence listing. Such functional homologs include Ceres CLONE ID no. 571200 (SEQ ID NO:494), Ceres CLONE ID no. 1928532 (SEQ ID NO:496), Ceres ANNOT ID no. 1490637 (SEQ ID NO:498), Ceres CLONE ID no. 295496 (SEQ ID NO:514), Public GI ID no. 115463637 (SEQ ID NO:515), and Ceres CLONE ID no. 1999444 (SEQ ID NO:518). Other functional homologs of SEQ ID NO:489 include Public GI ID no. 147844794 (SEQ ID NO:490), Public GI ID no. 147842279 (SEQ ID NO:491), Public GI ID no. 145355441 (SEQ ID NO:492), Ceres ANNOT ID no. 1461381 (SEQ ID NO:500), Ceres ANNOT ID no. 1440313 (SEQ ID NO:502), Ceres ANNOT ID no. 1448275 (SEQ ID NO:504), Ceres ANNOT ID no. 1437838 (SEQ ID NO:506), Ceres ANNOT ID no. 1501275 (SEQ ID NO:508), Ceres CLONE ID no. 1644562 (SEQ ID NO:510), Ceres CLONE ID no. 1925967 (SEQ ID NO:512), Public GI ID no. 115435904 (SEQ ID NO:516), Public GI ID no. 125552168 (SEQ ID NO:519), Public GI ID no. 125594093 (SEQ ID NO:520), Ceres CLONE ID no. 221188 (SEQ ID NO:522), Ceres ANNOT ID no. 1477714 (SEQ ID NO:524), Ceres CLONE ID no. 1787953 (SEQ ID NO:526), Ceres ANNOT ID no. 1531210 (SEQ ID NO:528), Ceres CLONE ID no. 521176 (SEQ ID NO:530), Public GI ID no. 22327055 (SEQ ID NO:531), Ceres ANNOT ID no. 1508824 (SEQ ID NO:533), Ceres CLONE ID no. 38879 (SEQ ID NO:535), Public GI ID no. 42569309 (SEQ ID NO:536), Ceres CLONE ID no. 1817784 (SEQ ID NO:538), Ceres CLONE ID no. 284637 (SEQ ID NO:540), Public GI ID no. 125596251 (SEQ ID NO:541), Public GI ID no. 125554300 (SEQ ID NO:543), Ceres CLONE ID no. 1935437 (SEQ ID NO:545), Ceres ANNOT ID no. 1455622 (SEQ ID NO:547), Public GI ID no. 55771354 (SEQ ID NO:548), Ceres ANNOT ID no. 1514655 (SEQ ID NO:550), Ceres CLONE ID no. 1848736 (SEQ ID NO:552), Public GI ID no. 125569872 (SEQ ID NO:553), Ceres CLONE ID no. 1645078 (SEQ ID NO:555), Ceres CLONE ID no. 1790573 (SEQ ID NO:557), Public GI ID no. 4567251 (SEQ ID NO:558), Ceres CLONE ID no. 444113 (SEQ ID NO:561), Public GI ID no. 125525355 (SEQ ID NO:562), Ceres ANNOT ID no. 6028854 (SEQ ID NO:564), and Ceres ANNOT ID no. 6115356 (SEQ ID NO:566). In some cases, a functional homolog of SEQ ID NO:489 has an amino acid sequence with at least 40% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:489.

Examples of amino acid sequences of functional homologs of the polypeptide set forth in SEQ ID NO:568 are provided in FIG. 3 and in the sequence listing. Such functional homologs include Ceres CLONE ID no. 695006 (SEQ ID NO:578) and Ceres ANNOT ID no. 1527488 (SEQ ID NO:584). Other functional homologs of SEQ ID NO:568 include Public GI ID no. 79318519 (SEQ ID NO:569), Public GI ID no. 79318537 (SEQ ID NO:570), Ceres CLONE ID no. 956998 (SEQ ID NO:572), Ceres CLONE ID no. 978154 (SEQ ID NO:574), Ceres CLONE ID no. 1035628 (SEQ ID NO:576), Ceres CLONE ID no. 464169 (SEQ ID NO:580), Ceres ANNOT ID no. 1474075 (SEQ ID NO:582), Ceres ANNOT ID no. 1474073 (SEQ ID NO:586), and Ceres ANNOT ID no. 1527486 (SEQ ID NO:588). In some cases, a functional homolog of SEQ ID NO:568 has an amino acid sequence with at least 40% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:568.

Figure 4:
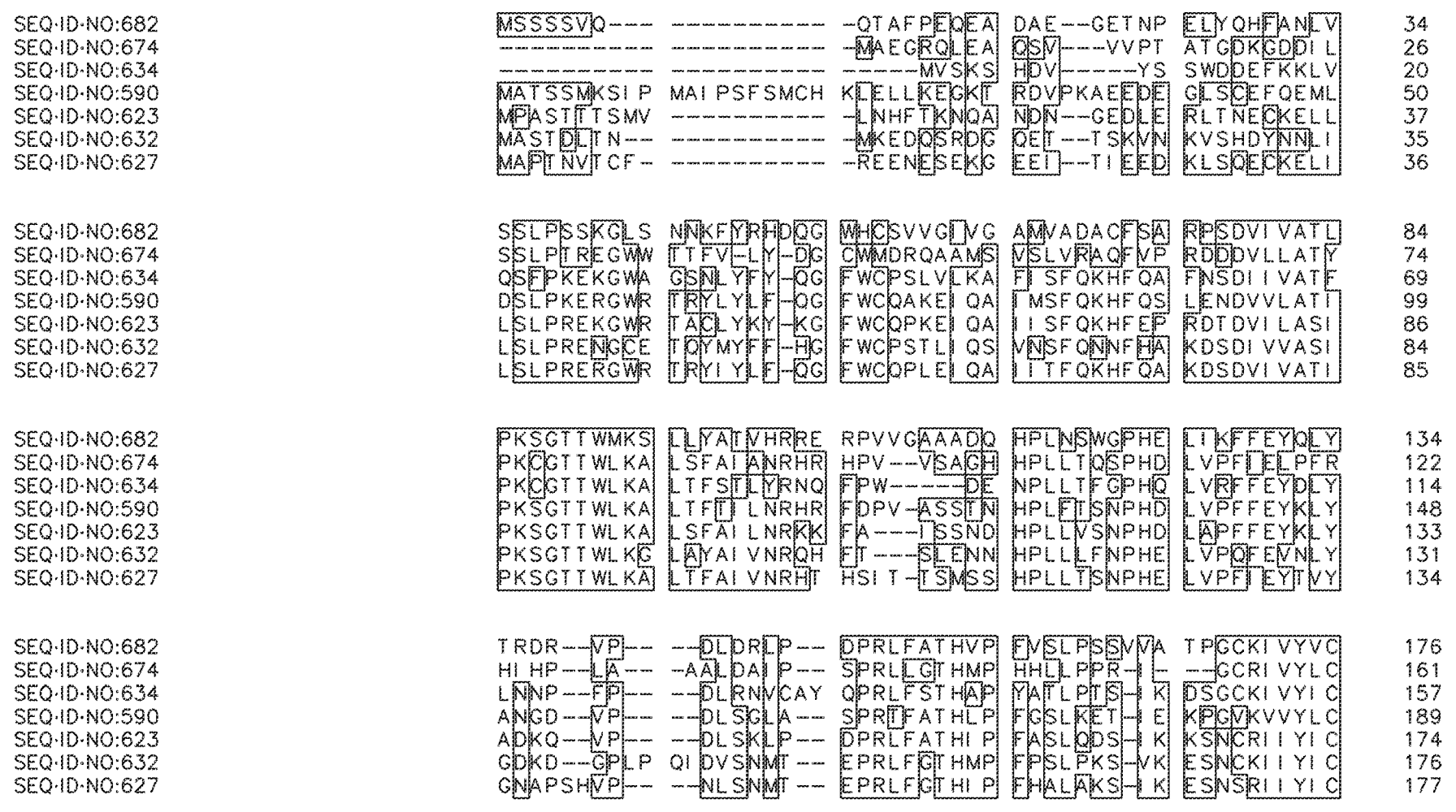
Figure 4:
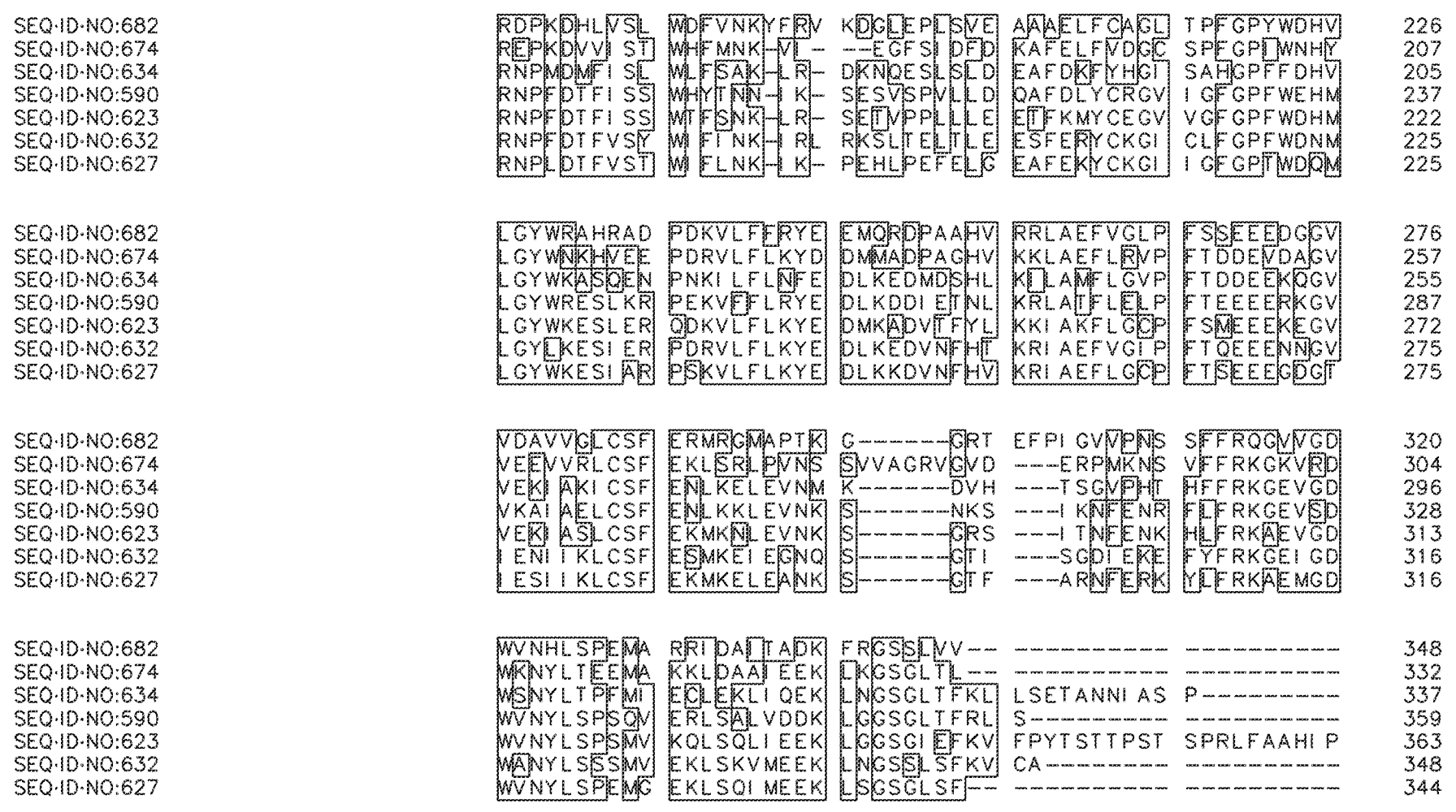

Examples of amino acid sequences of functional homologs of the polypeptide set forth in SEQ ID NO:590 are provided in FIG. 4 and in the sequence listing. Such functional homologs include Ceres ANNOT ID no. 1501305 (SEQ ID NO:623), Ceres CLONE ID no. 607280 (SEQ ID NO:627), Public GI ID no. 92887174 (SEQ ID NO:632), Ceres CLONE ID no. 1857162 (SEQ ID NO:634), Public GI ID no. 115477272 (SEQ ID NO:674), and Ceres CLONE ID no. 264002 (SEQ ID NO:682). Other functional homologs of SEQ ID NO:590 include Public GI ID no. 147822456 (SEQ ID NO:591), Public GI ID no. 144923935 (SEQ ID NO:592), Public GI ID no. 140038730 (SEQ ID NO:593), Public GI ID no. 78708014 (SEQ ID NO:594), Public GI ID no. 115481362 (SEQ ID NO:595), Public GI ID no. 125531350 (SEQ ID NO:596), Public GI ID no. 125525598 (SEQ ID NO:597), Public GI ID no. 77548630 (SEQ ID NO:598), Public GI ID no. 46798895 (SEQ ID NO:599), Public GI ID no. 125564653 (SEQ ID NO:600), Ceres CLONE ID no. 998865 (SEQ ID NO:602), Public GI ID no. 125556140 (SEQ ID NO:603), Public GI ID no. 125534482 (SEQ ID NO:604), Public GI ID no. 125550135 (SEQ ID NO:605), Ceres CLONE ID no. 639816 (SEQ ID NO:607), Public GI ID no. 125562170 (SEQ ID NO:608), Ceres CLONE ID no. 1797059 (SEQ ID NO:610), Ceres CLONE ID no. 1031510 (SEQ ID NO:612), Ceres CLONE ID no. 1973081 (SEQ ID NO:614), Public GI ID no. 125561002 (SEQ ID NO:615), Public GI ID no. 125541732 (SEQ ID NO:616), Public GI ID no. 125560677 (SEQ ID NO:617), Public GI ID no. 125559115 (SEQ ID NO:618), Public GI ID no. 15809903 (SEQ ID NO:619), Public GI ID no. 30681703 (SEQ ID NO:620), Public GI ID no. 9759556 (SEQ ID NO:621), Ceres ANNOT ID no. 1448303 (SEQ ID NO:625), Ceres ANNOT ID no. 1448305 (SEQ ID NO:629), Ceres ANNOT ID no. 1448307 (SEQ ID NO:631), Public GI ID no. 92888243 (SEQ ID NO:635), Public GI ID no. 92879395 (SEQ ID NO:636), Ceres CLONE ID no. 528876 (SEQ ID NO:638), Ceres ANNOT ID no. 1448352 (SEQ ID NO:640), Ceres ANNOT ID no. 1437745 (SEQ ID NO:642), Ceres ANNOT ID no. 1464146 (SEQ ID NO:644), Ceres ANNOT ID no. 1437744 (SEQ ID NO:646), Public GI ID no. 92894684 (SEQ ID NO:647), Ceres CLONE ID no. 3964 (SEQ ID NO:650), Public GI ID no. 13272389 (SEQ ID NO:651), Ceres ANNOT ID no. 1481203 (SEQ ID NO:653), Public GI ID no. 15227699 (SEQ ID NO:654), Public GI ID no. 92886084 (SEQ ID NO:655), Public GI ID no. 15239947 (SEQ ID NO:656), Ceres CLONE ID no. 34878 (SEQ ID NO:658), Ceres CLONE ID no. 150484 (SEQ ID NO:660), Public GI ID no. 21553545 (SEQ ID NO:661), Public GI ID no. 15222843 (SEQ ID NO:662), Public GI ID no. 38230552 (SEQ ID NO:663), Public GI ID no. 3420008 (SEQ ID NO:664), Public GI ID no. 15230602 (SEQ ID NO:665), Public GI ID no. 3420004 (SEQ ID NO:666), Public GI ID no. 2129586 (SEQ ID NO:667), Public GI ID no. 15217849 (SEQ ID NO:668), Public GI ID no. 15227704 (SEQ ID NO:669), Ceres ANNOT ID no. 1465750 (SEQ ID NO:671), Ceres CLONE ID no. 1983975 (SEQ ID NO:673), Public GI ID no. 15226028 (SEQ ID NO:675), Public GI ID no. 115459524 (SEQ ID NO:676), Ceres CLONE ID no. 1793353 (SEQ ID NO:678), Ceres ANNOT ID no. 1467399 (SEQ ID NO:680), Ceres CLONE ID no. 1982930 (SEQ ID NO:684), Public GI ID no. 125540700 (SEQ ID NO:685), Ceres ANNOT ID no. 1448743 (SEQ ID NO:687), Public GI ID no. 50251910 (SEQ ID NO:688), Ceres CLONE ID no. 1836748 (SEQ ID NO:690), Public GI ID no. 3420006 (SEQ ID NO:691), Public GI ID no. 92879376 (SEQ ID NO:692), Ceres CLONE ID no. 838941 (SEQ ID NO:694), Ceres ANNOT ID no. 1437746 (SEQ ID NO:696), Ceres ANNOT ID no. 6017241 (SEQ ID NO:698), Ceres ANNOT ID no. 6085947 (SEQ ID NO:700), and Ceres ANNOT ID no. 6017242 (SEQ ID NO:702). In some cases, a functional homolog of SEQ ID NO:590 has an amino acid sequence with at least 40% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:590.

Examples of amino acid sequences of functional homologs of the polypeptide set forth in SEQ ID NO:705 are provided in FIG. 5 and in the sequence listing. Such functional homologs include Public GI ID no. 79320952 (SEQ ID NO:706) and Public GI ID no. 79320957 (SEQ ID NO:707). Other functional homologs of SEQ ID NO:705 include Public GI ID no. 6692094 (SEQ ID NO:708) and Public GI ID no. 145323049 (SEQ ID NO:709). In some cases, a functional homolog of SEQ ID NO:705 has an amino acid sequence with at least 40% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:705.

Examples of amino acid sequences of functional homologs of the polypeptide set forth in SEQ ID NO:711 are provided in FIG. 6 and in the sequence listing. Such functional homologs include Ceres CLONE ID no. 964616 (SEQ ID NO:714), Ceres CLONE ID no. 100009667 (SEQ ID NO:715), Ceres ANNOT ID no. 1444568 (SEQ ID NO:719), Ceres CLONE ID no. 719489 (SEQ ID NO:725), Ceres CLONE ID no. 587748 (SEQ ID NO:733), Public GI ID no. 125528114 (SEQ ID NO:734), and Ceres CLONE ID no. 274172 (SEQ ID NO:737). Other functional homologs of SEQ ID NO:711 include Public GI ID no. 144923134 (SEQ ID NO:712), Ceres ANNOT ID no. 1471437 (SEQ ID NO:717), Ceres CLONE ID no. 1270484 (SEQ ID NO:721), Ceres CLONE ID no. 1075098 (SEQ ID NO:723), Public GI ID no. 18412211 (SEQ ID NO:727), Ceres CLONE ID no. 20358 (SEQ ID NO:729), Ceres CLONE ID no. 1915503 (SEQ ID NO:731), Public GI ID no. 115440619 (SEQ ID NO:735), Public GI ID no. 125572387 (SEQ ID NO:738), and Ceres ANNOT ID no. 6015812 (SEQ ID NO:740). In some cases, a functional homolog of SEQ ID NO:711 has an amino acid sequence with at least 40% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:711.

Examples of amino acid sequences of functional homologs of the polypeptide set forth in SEQ ID NO:742 are provided in FIG. 7 and in the sequence listing. Such functional homologs include Public GI ID no. 147783026 (SEQ ID NO: 743), Public GI ID no. 119367488 (SEQ ID NO: 744), Public GI ID no. 147860340 (SEQ ID NO: 745), Public GI ID no. 115477170 (SEQ ID NO: 757), Ceres CLONE ID no. 1620215 (SEQ ID NO: 759), Ceres CLONE ID no. 1931889 (SEQ ID NO: 761), Ceres CLONE ID no. 1798756 (SEQ ID NO: 763), Ceres CLONE ID no. 1918424 (SEQ ID NO: 767), Ceres CLONE ID no. 1845154 (SEQ ID NO: 771), Public GI ID no. 38016527 (SEQ ID NO: 796), Ceres Clone ID no. 1084216 (SEQ ID NO: 797), Public GI ID no. 113196593 (SEQ ID NO: 798), Public GI ID no. 75133829 (SEQ ID NO: 799), Ceres ANNOT ID no. 1460527 (SEQ ID NO: 801), Ceres Annot ID no. 8644540 (SEQ ID NO: 805), Ceres ANNOT ID no. 1450673 (SEQ ID NO: 807), Public GI ID no. 116778802 (SEQ ID NO: 808), Public GI ID no. 116778893 (SEQ ID NO: 809), Public GI ID no. 116778998 (SEQ ID NO: 810), Public GI ID no. 157849766 (SEQ ID NO: 811), Public GI ID no. 159474166 (SEQ ID NO: 812), Public GI ID no. 168036656 (SEQ ID NO: 813), Ceres ANNOT ID no. 1456578 (SEQ ID NO: 815), Public GI ID no. 168053490 (SEQ ID NO: 816), Public GI ID no. 193237563 (SEQ ID NO: 817), Ceres Clone ID no. 100879386 (SEQ ID NO: 819), Ceres Clone ID no. 2055733 (SEQ ID NO: 823), Ceres Clone ID no. 2056478 (SEQ ID NO: 825), Ceres CLONE ID no. 13007 (SEQ ID NO: 832), Ceres CLONE ID no. 5522 (SEQ ID NO: 834), Ceres CLONE ID no. 30543 (SEQ ID NO: 836), Ceres CLONE ID no. 14203 (SEQ ID NO: 839), Ceres CLONE ID no. 975913 (SEQ ID NO: 846), Ceres CLONE ID no. 967417 (SEQ ID NO: 848), Public GI ID no. 119720772 (SEQ ID NO: 857), Ceres CLONE ID no. 708446 (SEQ ID NO: 859), Ceres CLONE ID no. 1614593 (SEQ ID NO: 863), Ceres CLONE ID no. 2025938 (SEQ ID NO: 885), Public GI ID no. 92896423 (SEQ ID NO: 892), Ceres CLONE ID no. 634261 (SEQ ID NO: 900), Ceres CLONE ID no. 1387149 (SEQ ID NO: 912), Ceres CLONE ID no. 1423851 (SEQ ID NO: 918), Ceres CLONE ID no. 1589047 (SEQ ID NO: 939), Ceres CLONE ID no. 1748922 (SEQ ID NO: 944), Public GI ID no. 5031281 (SEQ ID NO: 953), Ceres CLONE ID no. 1775820 (SEQ ID NO: 955), Ceres CLONE ID no. 1787151 (SEQ ID NO: 957), Ceres CLONE ID no. 1765871 (SEQ ID NO: 973), Ceres CLONE ID no. 1990071 (SEQ ID NO: 977), Public GI ID no. 35187687 (SEQ ID NO: 988), Public GI ID no. 125556051 (SEQ ID NO: 989), Public GI ID no. 125561658 (SEQ ID NO: 990), Public GI ID no. 115468934 (SEQ ID NO: 991), Public GI ID no. 115470773 (SEQ ID NO: 992), Public GI ID no. 115444813 (SEQ ID NO: 993), Public GI ID no. 112819496 (SEQ ID NO: 999), Public GI ID no. 118424243 (SEQ ID NO: 1000), Ceres ANNOT ID no. 6063957 (SEQ ID NO: 1010), Public GI ID no. 169363 (SEQ ID NO:1215), Ceres CLONE ID no. 24255 (SEQ ID NO: 1242), Ceres Clone ID no. 1030374 (SEQ ID NO: 1306), Ceres Clone ID no. 1738028 (SEQ ID NO: 1308), Public GI ID no. 115455855 (SEQ ID NO: 1309), and Public GI ID no. 193237563 (SEQ ID NO: 1310). In some cases, a functional homolog of SEQ ID NO:742 has an amino acid sequence with at least 40% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:742.

Examples of amino acid sequences of functional homologs of the polypeptide set forth in SEQ ID NO:1012 are provided in FIG. 8 and in the sequence listing. Such functional homologs include Ceres CLONE ID no. 287430 (SEQ ID NO:1018), Ceres ANNOT ID no. 451889 (SEQ ID NO:1020), Ceres CLONE ID no. 936084 (SEQ ID NO:1055), Ceres CLONE ID no. 1792501 (SEQ ID NO:1066), Ceres ANNOT ID no. 1437875 (SEQ ID NO:1068), Public GI ID no. 1853968 (SEQ ID NO:1093), Public GI ID no. 27530032 (SEQ ID NO:1094), Ceres CLONE ID no. 1834483 (SEQ ID NO:1110), Public GI ID no. 84579418 (SEQ ID NO:1113), Public GI ID no. 15077030 (SEQ ID NO:1117), and Public GI ID no. 13752458 (SEQ ID NO:1118). Other functional homologs of SEQ ID NO:1012 include Public GI ID no. 147865685 (SEQ ID NO:1013), Public GI ID no. 119503368 (SEQ ID NO:1014), Public GI ID no. 72161874 (SEQ ID NO:1015), Public GI ID no. 91780661 (SEQ ID NO:1016), Ceres ANNOT ID no. 835908 (SEQ ID NO:1022), Public GI ID no. 38326750 (SEQ ID NO:1023), Ceres CLONE ID no. 1939396 (SEQ ID NO:1025), Ceres CLONE ID no. 403637 (SEQ ID NO:1027), Public GI ID no. 42539907 (SEQ ID NO:1028), Ceres CLONE ID no. 1836494 (SEQ ID NO:1030), Public GI ID no. 15192945 (SEQ ID NO:1031), Ceres CLONE ID no. 1607947 (SEQ ID NO:1033), Ceres CLONE ID no. 115880 (SEQ ID NO:1035), Ceres CLONE ID no. 1074009 (SEQ ID NO:1037), Ceres CLONE ID no. 476073 (SEQ ID NO:1039), Ceres CLONE ID no. 554053 (SEQ ID NO:1041), Ceres CLONE ID no. 391449 (SEQ ID NO:1045), Ceres CLONE ID no. 1846400 (SEQ ID NO:1048), Ceres ANNOT ID no. 1475185 (SEQ ID NO:1050), Public GI ID no. 115457148 (SEQ ID NO:1051), Ceres ANNOT ID no. 1454960 (SEQ ID NO:1053), Public GI ID no. 50346893 (SEQ ID NO:1056), Ceres CLONE ID no. 1931526 (SEQ ID NO:1058), Ceres ANNOT ID no. 1454260 (SEQ ID NO:1061), Public GI ID no. 115456131 (SEQ ID NO:1062), Ceres CLONE ID no. 159151 (SEQ ID NO:1064), Ceres CLONE ID no. 1842801 (SEQ ID NO:1071), Ceres CLONE ID no. 533030 (SEQ ID NO:1073), Ceres CLONE ID no. 1931881 (SEQ ID NO:1075), Ceres ANNOT ID no. 1480006 (SEQ ID NO:1077), Ceres CLONE ID no. 1895007 (SEQ ID NO:1079), Public GI ID no. 3598863 (SEQ ID NO:1080), Ceres ANNOT ID no. 1471735 (SEQ ID NO:1082), Ceres CLONE ID no. 1937530 (SEQ ID NO:1084), Ceres CLONE ID no. 1833050 (SEQ ID NO:1086), Ceres CLONE ID no. 644213 (SEQ ID NO:1088), Ceres CLONE ID no. 568154 (SEQ ID NO:1090), Ceres CLONE ID no. 527598 (SEQ ID NO:1092), Ceres ANNOT ID no. 1487614 (SEQ ID NO:1096), Ceres ANNOT ID no. 1541881 (SEQ ID NO:1098), Ceres ANNOT ID no. 1488465 (SEQ ID NO:1100), Ceres ANNOT ID no. 1488468 (SEQ ID NO:1102), Ceres ANNOT ID no. 1541884 (SEQ ID NO:1104), Ceres ANNOT ID no. 1454972 (SEQ ID NO:1106), Ceres ANNOT ID no. 1475186 (SEQ ID NO:1108), Ceres CLONE ID no. 686198 (SEQ ID NO:1112), Public GI ID no. 84579420 (SEQ ID NO:1114), Ceres CLONE ID no. 605144 (SEQ ID NO:1116), Public GI ID no. 15077028 (SEQ ID NO:1119), Ceres ANNOT ID no. 1454963 (SEQ ID NO:1121), Ceres ANNOT ID no. 6030208 (SEQ ID NO:1123), and Ceres ANNOT ID no. 6076767 (SEQ ID NO:1125). In some cases, a functional homolog of SEQ ID NO:1012 has an amino acid sequence with at least 40% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:1012.

Examples of amino acid sequences of functional homologs of the polypeptide set forth in SEQ ID NO:1129 are provided in FIG. 9 and in the sequence listing. Such functional homologs include Public GI ID no. 72255610 (SEQ ID NO:933), Ceres SEEDLINE ID no. ME20095 (SEQ ID NO:1129), Ceres CLONE ID no. 1562633 (SEQ ID NO:1140), Ceres ANNOT ID no. 1692728 (SEQ ID NO:1142), Ceres CLONE ID no. 921110 (SEQ ID NO:1144), Ceres CLONE ID no. 1791180 (SEQ ID NO:1146), Ceres CLONE ID no. 527891 (SEQ ID NO:1148), Ceres ANNOT ID no. 1522414 (SEQ ID NO:1150), and Public GI ID no. 51458330 (SEQ ID NO:1182). Other functional homologs of SEQ ID NO:1129 include Public GI ID no. 18399940 (SEQ ID NO:63), Ceres ANNOT ID no. 6107929 (SEQ ID NO:73), Ceres ANNOT ID no. 1473094 (SEQ ID NO:96), Ceres ANNOT ID no. 1503955 (SEQ ID NO:127), Ceres ANNOT ID no. 1526501 (SEQ ID NO:139), Public GI ID no. 15235713 (SEQ ID NO:179), Public GI ID no. 15234552 (SEQ ID NO:180), Ceres ANNOT ID no. 1520801 (SEQ ID NO:209), Ceres ANNOT ID no. 1443434 (SEQ ID NO:467), Public GI ID no. 30696058 (SEQ ID NO:559), Ceres ANNOT ID no. 1509601 (SEQ ID NO:648), Ceres ANNOT ID no. 1451912 (SEQ ID NO:726), Ceres ANNOT ID no. 6017545 (SEQ ID NO:741), Ceres ANNOT ID no. 1504999 (SEQ ID NO:765), Ceres ANNOT ID no. 1456402 (SEQ ID NO:773), Ceres ANNOT ID no. 1496359 (SEQ ID NO:781), Ceres ANNOT ID no. 1447260 (SEQ ID NO:842), Ceres ANNOT ID no. 1469023 (SEQ ID NO:861), Ceres ANNOT ID no. 1474186 (SEQ ID NO:865), Ceres ANNOT ID no. 1527596 (SEQ ID NO:867), Ceres CLONE ID no. 1919624 (SEQ ID NO:896), Ceres CLONE ID no. 677797 (SEQ ID NO:916), Public GI ID no. 7960729 (SEQ ID NO:932), Ceres CLONE ID no. 941845 (SEQ ID NO:1043), Public GI ID no. 30683008 (SEQ ID NO:1046), Public GI ID no. 42568786 (SEQ ID NO:1059), Ceres CLONE ID no. 255364 (SEQ ID NO:1069), Public GI ID no. 147771549 (SEQ ID NO:1130), Public GI ID no. 144924741 (SEQ ID NO:1131), Public GI ID no. 121594508 (SEQ ID NO:1132), Public GI ID no. 91202290 (SEQ ID NO:1133), Public GI ID no. 89900939 (SEQ ID NO:1134), Public GI ID no. 77917672 (SEQ ID NO:1135), Public GI ID no. 77165252 (SEQ ID NO:1136), Public GI ID no. 115375374 (SEQ ID NO:1137), Public GI ID no. 110602449 (SEQ ID NO:1138), Public GI ID no. 125540573 (SEQ ID NO:1151), Public GI ID no. 125561519 (SEQ ID NO:1152), Public GI ID no. 125528345 (SEQ ID NO:1153), Public GI ID no. 116310408 (SEQ ID NO:1154), Public GI ID no. 115483332 (SEQ ID NO:1156), Public GI ID no. 125575640 (SEQ ID NO:1157), Public GI ID no. 115476368 (SEQ ID NO:1158), Public GI ID no. 115478841 (SEQ ID NO:1159), Public GI ID no. 115467158 (SEQ ID NO:1160), Public GI ID no. 72384477 (SEQ ID NO:1161), Public GI ID no. 116054703 (SEQ ID NO:1162), Ceres CLONE ID no. 1786317 (SEQ ID NO:1164), Ceres CLONE ID no. 1791336 (SEQ ID NO:1166), Ceres CLONE ID no. 1877752 (SEQ ID NO:1168), Ceres CLONE ID no. 1821191 (SEQ ID NO:1170), Ceres CLONE ID no. 446838 (SEQ ID NO:1172), Ceres CLONE ID no. 1556915 (SEQ ID NO:1174), Public GI ID no. 90200725 (SEQ ID NO:1175), Ceres CLONE ID no. 1580247 (SEQ ID NO:1177), Ceres CLONE ID no. 644201 (SEQ ID NO:1179), Ceres CLONE ID no. 538689 (SEQ ID NO:1181), Ceres CLONE ID no. 817225 (SEQ ID NO:1184), and Ceres CLONE ID no. 923842 (SEQ ID NO:1186). In some cases, a functional homolog of SEQ ID NO:1129 has an amino acid sequence with at least 40% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:1129.

Examples of amino acid sequences of functional homologs of the polypeptide set forth in SEQ ID NO:60 are provided in FIG. 10 and in the sequence listing. Such functional homologs include Ceres CLONE ID no. 872030 (SEQ ID NO:62), Ceres CLONE ID no. 100029223 (SEQ ID NO:74), Ceres CLONE ID no. 1939845 (SEQ ID NO:98), Ceres CLONE ID no. 2015383 (SEQ ID NO:102), Ceres CLONE ID no. 1607893 (SEQ ID NO:104), Ceres CLONE ID no. 1075133 (SEQ ID NO:152), and Ceres CLONE ID no. 1218065 (SEQ ID NO:915). Other functional homologs of SEQ ID NO:60 include Public GI ID no. 15227919 (SEQ ID NO:64), Public GI ID no. 9843641 (SEQ ID NO:65), Public GI ID no. 124294789 (SEQ ID NO:66), Public GI ID no. 15233446 (SEQ ID NO:67), Public GI ID no. 115477679 (SEQ ID NO:68), Public GI ID no. 42407552 (SEQ ID NO:69), Public GI ID no. 125562450 (SEQ ID NO:70), Public GI ID no. 115469980 (SEQ ID NO:71), Ceres ANNOT ID no. 1442539 (SEQ ID NO:76), Ceres ANNOT ID no. 1442538 (SEQ ID NO:78), Ceres ANNOT ID no. 1460661 (SEQ ID NO:80), Ceres ANNOT ID no. 1452884 (SEQ ID NO:82), Ceres ANNOT ID no. 1450523 (SEQ ID NO:84), Ceres ANNOT ID no. 1442257 (SEQ ID NO:86), Ceres ANNOT ID no. 1541121 (SEQ ID NO:88), Ceres ANNOT ID no. 1480481 (SEQ ID NO:90), Ceres ANNOT ID no. 1487713 (SEQ ID NO:92), Ceres ANNOT ID no. 1456204 (SEQ ID NO:94), Ceres CLONE ID no. 1387402 (SEQ ID NO:100), Ceres CLONE ID no. 972919 (SEQ ID NO:106), Ceres CLONE ID no. 1645860 (SEQ ID NO:108), Ceres CLONE ID no. 1042804 (SEQ ID NO:110), Ceres CLONE ID no. 1606678 (SEQ ID NO:112), Ceres CLONE ID no. 684496 (SEQ ID NO:114), Ceres CLONE ID no. 1062366 (SEQ ID NO:116), Ceres CLONE ID no. 1722931 (SEQ ID NO:118), Ceres CLONE ID no. 746169 (SEQ ID NO:120), Ceres CLONE ID no. 1050475 (SEQ ID NO:122), Ceres CLONE ID no. 1728904 (SEQ ID NO:124), Ceres CLONE ID no. 1698538 (SEQ ID NO:126), Ceres CLONE ID no. 1762328 (SEQ ID NO:130), Ceres CLONE ID no. 1590072 (SEQ ID NO:132), Ceres CLONE ID no. 471593 (SEQ ID NO:134), Ceres CLONE ID no. 1031667 (SEQ ID NO:136), Ceres CLONE ID no. 1826085 (SEQ ID NO:138), Ceres CLONE ID no. 373932 (SEQ ID NO:142), Ceres CLONE ID no. 1797836 (SEQ ID NO:144), Ceres CLONE ID no. 1102774 (SEQ ID NO:146), Ceres CLONE ID no. 842287 (SEQ ID NO:148), Ceres CLONE ID no. 568205 (SEQ ID NO:150), Ceres ANNOT ID no. 6108997 (SEQ ID NO:154), Ceres ANNOT ID no. 6023609 (SEQ ID NO:156), and Ceres ANNOT ID no. 6017906 (SEQ ID NO:158). In some cases, a functional homolog of SEQ ID NO:60 has an amino acid sequence with at least 40% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:60.

Examples of amino acid sequences of functional homologs of the polypeptide set forth in SEQ ID NO:364 are provided in FIG. 11 and in the sequence listing. Such functional homologs include Ceres ANNOT ID no. 1455221 (SEQ ID NO:407), Public GI ID no. 729774 (SEQ ID NO:408), Ceres CLONE ID no. 1414288 (SEQ ID NO:410), Public GI ID no. 115482048 (SEQ ID NO:413), and Public GI ID no. 56117815 (SEQ ID NO:421). Other functional homologs of SEQ ID NO:364 include Ceres ANNOT ID no. 1485538 (SEQ ID NO:366), Ceres ANNOT ID no. 1538505 (SEQ ID NO:368), Public GI ID no. 8347238 (SEQ ID NO:369), Public GI ID no. 125542955 (SEQ ID NO:370), Public GI ID no. 115446219 (SEQ ID NO:371), Ceres CLONE ID no. 1597127 (SEQ ID NO:373), Ceres CLONE ID no. 1584568 (SEQ ID NO:375), Ceres CLONE ID no. 286056 (SEQ ID NO:377), Ceres ANNOT ID no. 1543432 (SEQ ID NO:379), Ceres CLONE ID no. 1728062 (SEQ ID NO:381), Ceres ANNOT ID no. 1448950 (SEQ ID NO:383), Ceres CLONE ID no. 771500 (SEQ ID NO:385), Ceres ANNOT ID no. 1485096 (SEQ ID NO:387), Ceres CLONE ID no. 1646104 (SEQ ID NO:389), Public GI ID no. 111184724 (SEQ ID NO:390), Ceres CLONE ID no. 1362475 (SEQ ID NO:392), Ceres CLONE ID no. 597906 (SEQ ID NO:394), Ceres CLONE ID no. 615781 (SEQ ID NO:396), Ceres CLONE ID no. 538713 (SEQ ID NO:398), Ceres CLONE ID no. 1794141 (SEQ ID NO:400), Public GI ID no. 5821138 (SEQ ID NO:401), Public GI ID no. 886742 (SEQ ID NO:402), Ceres CLONE ID no. 1814498 (SEQ ID NO:404), Public GI ID no. 7158882 (SEQ ID NO:405), Ceres ANNOT ID no. 1452564 (SEQ ID NO:412), Public GI ID no. 125557431 (SEQ ID NO:414), Ceres ANNOT ID no. 1442880 (SEQ ID NO:416), Ceres ANNOT ID no. 1463437 (SEQ ID NO:418), Public GI ID no. 42415865 (SEQ ID NO:419), Public GI ID no. 33087081 (SEQ ID NO:420), Public GI ID no. 115521217 (SEQ ID NO:422), Public GI ID no. 115521211 (SEQ ID NO:423), Public GI ID no. 115521215 (SEQ ID NO:424), Ceres ANNOT ID no. 1454376 (SEQ ID NO:426), Ceres CLONE ID no. 835571 (SEQ ID NO:428), Ceres ANNOT ID no. 1500046 (SEQ ID NO:430), Public GI ID no. 110738569 (SEQ ID NO:431), Public GI ID no. 125542510 (SEQ ID NO:432), Public GI ID no. 30686034 (SEQ ID NO:433), Public GI ID no. 125570883 (SEQ ID NO:434), Public GI ID no. 42562463 (SEQ ID NO:435), Ceres CLONE ID no. 100043265 (SEQ ID NO:436), Ceres ANNOT ID no. 6089790 (SEQ ID NO:438), and Ceres ANNOT ID no. 6043635 (SEQ ID NO:440). In some cases, a functional homolog of SEQ ID NO:364 has an amino acid sequence with at least 40% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:364.

Examples of amino acid sequences of functional homologs of the polypeptide set forth in SEQ ID NO:311 are provided in FIG. 12 and in the sequence listing. Such functional homologs include Ceres ANNOT ID no. 1538958 (SEQ ID NO:319), Public GI ID no. 115521213 (SEQ ID NO:320), Public GI ID no. 42415865 (SEQ ID NO:321), Public GI ID no. 729775 (SEQ ID NO:322), Public GI ID no. 11386827 (SEQ ID NO:323), Public GI ID no. 115456675 (SEQ ID NO:326), and Public GI ID no. 89274218 (SEQ ID NO:335). Other functional homologs of SEQ ID NO:311 include Public GI ID no. 125546035 (SEQ ID NO:312), Ceres CLONE ID no. 125228 (SEQ ID NO:314), Public GI ID no. 115465055 (SEQ ID NO:315), Public GI ID no. 125553080 (SEQ ID NO:316), Public GI ID no. 8920606 (SEQ ID NO:317), Ceres CLONE ID no. 1919643 (SEQ ID NO:325), Public GI ID no. 429155 (SEQ ID NO:327), Ceres CLONE ID no. 1194199 (SEQ ID NO:329), Public GI ID no. 15236631 (SEQ ID NO:330), Ceres ANNOT ID no. 1523420 (SEQ ID NO:332), Ceres ANNOT ID no. 1447046 (SEQ ID NO:334), Public GI ID no. 25296101 (SEQ ID NO:336), Public GI ID no. 15228440 (SEQ ID NO:337), Public GI ID no. 6624612 (SEQ ID NO:338), Public GI ID no. 125588688 (SEQ ID NO:339), Public GI ID no. 115470859 (SEQ ID NO:340), Public GI ID no. 15228865 (SEQ ID NO:341), Ceres CLONE ID no. 1571069 (SEQ ID NO:343), Public GI ID no. 115455903 (SEQ ID NO:344), Ceres ANNOT ID no. 1459422 (SEQ ID NO:346), Ceres CLONE ID no. 1577511 (SEQ ID NO:348), Public GI ID no. 115451657 (SEQ ID NO:349), Public GI ID no. 15225255 (SEQ ID NO:350), Public GI ID no. 125545695 (SEQ ID NO:351), Ceres ANNOT ID no. 1471817 (SEQ ID NO:353), Ceres ANNOT ID no. 1440896 (SEQ ID NO:355), Public GI ID no. 119393868 (SEQ ID NO:356), Ceres ANNOT ID no. 1517025 (SEQ ID NO:358), Ceres ANNOT ID no. 1512410 (SEQ ID NO:360), and Ceres ANNOT ID no. 6035498 (SEQ ID NO:362). In some cases, a functional homolog of SEQ ID NO:311 has an amino acid sequence with at least 40% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:311.

Examples of amino acid sequences of functional homologs of the polypeptide set forth in SEQ ID NO:160 are provided in FIG. 13 and in the sequence listing. Such functional homologs include Ceres CLONE ID no. 1837065 (SEQ ID NO:162), Ceres ANNOT ID no. 1531178 (SEQ ID NO:184), Ceres CLONE ID no. 470694 (SEQ ID NO:242), Public GI ID no. 92867368 (SEQ ID NO:253), Ceres CLONE ID no. 859707 (SEQ ID NO:256), Ceres CLONE ID no. 392275 (SEQ ID NO:268), Ceres CLONE ID no. 1828394 (SEQ ID NO:282), and Public GI ID no. 115466694 (SEQ ID NO:294). Other functional homologs of SEQ ID NO:160 include Ceres CLONE ID no. 1895763 (SEQ ID NO:164), Ceres CLONE ID no. 1850460 (SEQ ID NO:166), Ceres CLONE ID no. 1808074 (SEQ ID NO:168), Ceres CLONE ID no. 1832882 (SEQ ID NO:170), Ceres CLONE ID no. 1978977 (SEQ ID NO:172), Ceres CLONE ID no. 1918742 (SEQ ID NO:174), Ceres CLONE ID no. 1940023 (SEQ ID NO:176), Ceres CLONE ID no. 1923495 (SEQ ID NO:178), Ceres CLONE ID no. 1851388 (SEQ ID NO:182), Ceres ANNOT ID no. 1477681 (SEQ ID NO:186), Ceres ANNOT ID no. 1508800 (SEQ ID NO:188), Ceres ANNOT ID no. 1455597 (SEQ ID NO:190), Ceres ANNOT ID no. 1532016 (SEQ ID NO:192), Ceres ANNOT ID no. 1478526 (SEQ ID NO:194), Ceres ANNOT ID no. 1492567 (SEQ ID NO:196), Ceres ANNOT ID no. 1515273 (SEQ ID NO:198), Ceres ANNOT ID no. 1461979 (SEQ ID NO:200), Ceres ANNOT ID no. 1439702 (SEQ ID NO:202), Ceres ANNOT ID no. 1448044 (SEQ ID NO:204), Ceres ANNOT ID no. 1483370 (SEQ ID NO:206), Ceres ANNOT ID no. 1445651 (SEQ ID NO:208), Ceres ANNOT ID no. 1490863 (SEQ ID NO:212), Ceres ANNOT ID no. 1501043 (SEQ ID NO:214), Ceres ANNOT ID no. 1527507 (SEQ ID NO:216), Ceres ANNOT ID no. 1498633 (SEQ ID NO:218), Ceres ANNOT ID no. 1465403 (SEQ ID NO:220), Ceres ANNOT ID no. 1510956 (SEQ ID NO:222), Ceres ANNOT ID no. 1457735 (SEQ ID NO:224), Public GI ID no. 15224711 (SEQ ID NO:225), Ceres CLONE ID no. 40062 (SEQ ID NO:228), Public GI ID no. 15220315 (SEQ ID NO:229), Ceres CLONE ID no. 36480 (SEQ ID NO:231), Ceres CLONE ID no. 2443 (SEQ ID NO:233), Public GI ID no. 30685375 (SEQ ID NO:234), Public GI ID no. 126009434 (SEQ ID NO:235), Ceres CLONE ID no. 965753 (SEQ ID NO:237), Ceres CLONE ID no. 948834 (SEQ ID NO:239), Public GI ID no. 33347409 (SEQ ID NO:240), Ceres CLONE ID no. 643614 (SEQ ID NO:244), Ceres CLONE ID no. 1049362 (SEQ ID NO:246), Ceres CLONE ID no. 546675 (SEQ ID NO:248), Ceres CLONE ID no. 522046 (SEQ ID NO:250), Ceres CLONE ID no. 651076 (SEQ ID NO:252), Public GI ID no. 92897590 (SEQ ID NO:254), Ceres CLONE ID no. 634176 (SEQ ID NO:258), Ceres CLONE ID no. 1041432 (SEQ ID NO:260), Ceres CLONE ID no. 1065203 (SEQ ID NO:262), Ceres CLONE ID no. 555361 (SEQ ID NO:264), Ceres CLONE ID no. 704227 (SEQ ID NO:266), Ceres CLONE ID no. 100819945 (SEQ ID NO:269), Ceres CLONE ID no. 282584 (SEQ ID NO:271), Ceres CLONE ID no. 1448469 (SEQ ID NO:273), Ceres CLONE ID no. 241246 (SEQ ID NO:275), Ceres CLONE ID no. 234443 (SEQ ID NO:277), Ceres CLONE ID no. 293549 (SEQ ID NO:279), Public GI ID no. 109450926 (SEQ ID NO:280), Ceres CLONE ID no. 1803923 (SEQ ID NO:284), Ceres CLONE ID no. 2024557 (SEQ ID NO:286), Ceres CLONE ID no. 1820364 (SEQ ID NO:288), Public GI ID no. 125554274 (SEQ ID NO:289), Public GI ID no. 125531165 (SEQ ID NO:290), Public GI ID no. 125541514 (SEQ ID NO:291), Public GI ID no. 125557559 (SEQ ID NO:292), Public GI ID no. 125557844 (SEQ ID NO:293), Public GI ID no. 115449295 (SEQ ID NO:295), Public GI ID no. 115481182 (SEQ ID NO:296), Public GI ID no. 20177639 (SEQ ID NO:297), Public GI ID no. 115471021 (SEQ ID NO:298), Public GI ID no. 115456011 (SEQ ID NO:299), Public GI ID no. 125588290 (SEQ ID NO:300), Public GI ID no. 115477799 (SEQ ID NO:301), Public GI ID no. 115471385 (SEQ ID NO:302), Public GI ID no. 125599705 (SEQ ID NO:303), Public GI ID no. 115489810 (SEQ ID NO:304), Public GI ID no. 55276718 (SEQ ID NO:305), Ceres ANNOT ID no. 6025568 (SEQ ID NO:307), and Ceres ANNOT ID no. 6091128 (SEQ ID NO:309). In some cases, a functional homolog of SEQ ID NO:160 has an amino acid sequence with at least 40% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:160.

Examples of amino acid sequences of functional homologs of the polypeptide set forth in SEQ ID NO:2 are provided in FIG. 14 and in the sequence listing. Such functional homologs include Public GI ID no. 115470807 (SEQ ID NO:5), Ceres CLONE ID no. 1842931 (SEQ ID NO:15), Ceres CLONE ID no. 321308 (SEQ ID NO:17), Ceres CLONE ID no. 1725811 (SEQ ID NO:19), Ceres CLONE ID no. 1357455 (SEQ ID NO:21), Ceres CLONE ID no. 943370 (SEQ ID NO:23), Ceres CLONE ID no. 1327712 (SEQ ID NO:25), Ceres CLONE ID no. 1764692 (SEQ ID NO:27), and Ceres ANNOT ID no. 1512656 (SEQ ID NO:41). Other functional homologs of SEQ ID NO:2 include Public GI ID no. 18403425 (SEQ ID NO:3), Public GI ID no. 11994285 (SEQ ID NO:4), Public GI ID no. 108706298 (SEQ ID NO:6), Public GI ID no. 15233585 (SEQ ID NO:7), Public GI ID no. 125599279 (SEQ ID NO:8), Public GI ID no. 115450865 (SEQ ID NO:9), Public GI ID no. 22773244 (SEQ ID NO:10), Public GI ID no. 92874749 (SEQ ID NO:11), Ceres CLONE ID no. 1857034 (SEQ ID NO:13), Ceres CLONE ID no. 1059300 (SEQ ID NO:29), Ceres CLONE ID no. 1804869 (SEQ ID NO:31), Ceres CLONE ID no. 378863 (SEQ ID NO:33), Ceres CLONE ID no. 1930271 (SEQ ID NO:35), Ceres CLONE ID no. 2034728 (SEQ ID NO:37), Ceres CLONE ID no. 1866421 (SEQ ID NO:39), Ceres ANNOT ID no. 1463492 (SEQ ID NO:43), Ceres ANNOT ID no. 1459391 (SEQ ID NO:45), Ceres ANNOT ID no. 1442920 (SEQ ID NO:47), Ceres ANNOT ID no. 6011447 (SEQ ID NO:49), Ceres ANNOT ID no. 6068218 (SEQ ID NO:51), Ceres ANNOT ID no. 6044121 (SEQ ID NO:53), and Ceres ANNOT ID no. 6100755 (SEQ ID NO:55). In some cases, a functional homolog of SEQ ID NO:2 has an amino acid sequence with at least 40% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:2.

Examples of amino acid sequences of functional homologs of the polypeptide set forth in SEQ ID NO:749 are provided in FIG. 15 and in the sequence listing. Such functional homologs include Ceres CLONE ID no. 1847516 (SEQ ID NO:1195), Ceres CLONE ID no. 1961986 (SEQ ID NO:1201), and Ceres ANNOT ID no. 6091930 (SEQ ID NO:1207). Other functional homologs of SEQ ID NO:749 include Ceres CLONE ID no. 2025938 (SEQ ID NO:885), Ceres CLONE ID no. 1821214 (SEQ ID NO:1189), Ceres CLONE ID no. 1040399 (SEQ ID NO:1191), Ceres CLONE ID no. 1093691 (SEQ ID NO:1193), Ceres CLONE ID no. 974539 (SEQ ID NO:1197), Ceres CLONE ID no. 1832340 (SEQ ID NO:1199), Ceres CLONE ID no. 1933211 (SEQ ID NO:1203), Ceres CLONE ID no. 997558 (SEQ ID NO:1205), Ceres ANNOT ID no. 6041596 (SEQ ID NO:1209), Public GI ID no. 125564176 (SEQ ID NO:1210), Ceres CLONE ID no. 1836064 (SEQ ID NO:1212), Ceres CLONE ID no. 1909693 (SEQ ID NO:1214), Public GI ID no. 40287480 (SEQ ID NO:1216), Ceres CLONE ID no. 1765346 (SEQ ID NO:1218), Public GI ID no. 125546008 (SEQ ID NO:1219), Ceres CLONE ID no. 1950900 (SEQ ID NO:1221), Public GI ID no. 41350259 (SEQ ID NO:1222), Public GI ID no. 125588210 (SEQ ID NO:1223), Ceres CLONE ID no. 1954395 (SEQ ID NO:1225), Public GI ID no. 18403408 (SEQ ID NO:1226), Ceres CLONE ID no. 2010121 (SEQ ID NO:1228), Ceres ANNOT ID no. 6011486 (SEQ ID NO:1230), Public GI ID no. 25082726 (SEQ ID NO:1231), Public GI ID no. 113196593 (SEQ ID NO:1232), Ceres CLONE ID no. 1843021 (SEQ ID NO:1234), Ceres CLONE ID no. 1931194 (SEQ ID NO:1236), Ceres CLONE ID no. 1652996 (SEQ ID NO:1238), Ceres CLONE ID no. 1930044 (SEQ ID NO:1240), Ceres CLONE ID no. 24255 (SEQ ID NO:1242), Ceres ANNOT ID no. 6034955 (SEQ ID NO:1244), Ceres ANNOT ID no. 6119444 (SEQ ID NO:1246), Ceres ANNOT ID no. 6063956 (SEQ ID NO:1248), Ceres ANNOT ID no. 6015461 (SEQ ID NO:1250), Ceres CLONE ID no. 696244 (SEQ ID NO:1252), Ceres ANNOT ID no. 1468973 (SEQ ID NO:1254), Ceres CLONE ID no. 2019529 (SEQ ID NO:1256), and Ceres CLONE ID no. 1492169 (SEQ ID NO:1258). In some cases, a functional homolog of SEQ ID NO:749 has an amino acid sequence with at least 40% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:749.

Examples of amino acid sequences of functional homologs of the polypeptide set forth in SEQ ID NO:1311 are provided in FIG. 16 and in the sequence listing. Such functional homologs include CeresClone:971761 (SEQ ID NO: 1313), CeresClone:1946574 (SEQ ID NO: 1331), CeresClone:2055551 (SEQ ID NO: 1340), CeresClone: 100045499 (SEQ ID NO: 1347), CeresClone:1465853 (SEQ ID NO: 1353), CeresClone:753982 (SEQ ID NO: 1360), CeresClone:1076093 (SEQ ID NO: 1315), CeresClone: 1627875 (SEQ ID NO: 1317), CeresAnnot:1508362 (SEQ ID NO: 1319), CeresAnnot:1526950 (SEQ ID NO: 1321), CeresClone:1832333 (SEQ ID NO: 1323), GI:74272607 (SEQ ID NO: 1324), GI:192910782 (SEQ ID NO: 1325), GI:157342563 (SEQ ID NO: 1326), GI:159483497 (SEQ ID NO: 1327), CeresClone:1839999 (SEQ ID NO: 1329), CeresClone:467335 (SEQ ID NO: 1333), GI:168010087 (SEQ ID NO: 1334), CeresClone:1728202 (SEQ ID NO: 1336), CeresClone:1994239 (SEQ ID NO: 1338), CeresAnnot:8704704 (SEQ ID NO: 1342), GI:115453877 (SEQ ID NO: 1343), CeresClone:1646411 (SEQ ID NO: 1345), CeresClone:100920260 (SEQ ID NO: 1349), GI:116786147 (SEQ ID NO: 1350), GI:116783944 (SEQ ID NO: 1351), GI:82623397 (SEQ ID NO: 1354), CeresAnnot:8656662 (SEQ ID NO: 1356), CeresClone:1417803 (SEQ ID NO: 1358), and GI:145345927 (SEQ ID NO: 1361). In some cases, a functional homolog of SEQ ID NO:1311 has an amino acid sequence with at least 40% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:1311.

The identification of conserved regions in a heat and/or drought-tolerance polypeptide facilitates production of variants of heat and/or drought-tolerance polypeptides. Variants of heat and/or drought-tolerance polypeptides typically have 10 or fewer conservative amino acid substitutions within the primary amino acid sequence, e.g., 7 or fewer conservative amino acid substitutions, 5 or fewer conservative amino acid substitutions, or between 1 and 5 conservative substitutions. A useful variant polypeptide can be constructed based on one of the alignments set forth in FIGS. 1-16. Such a polypeptide includes the conserved regions, arranged in the order depicted in the Figure from amino-terminal end to carboxy-terminal end. Such a polypeptide may also include zero, one, or more than one amino acid in positions marked by dashes. When no amino acids are present at positions marked by dashes, the length of such a polypeptide is the sum of the amino acid residues in all conserved regions. When amino acids are present at all positions marked by dashes, such a polypeptide has a length that is the sum of the amino acid residues in all conserved regions and all dashes.

C. Functional Homologs Identified by HMMER

In some embodiments, useful heat and/or drought-tolerance polypeptides include those that fit a Hidden Markov Model based on the polypeptides set forth in any one of FIGS. 1-16. A Hidden Markov Model (HMM) is a statistical model of a consensus sequence for a group of functional homologs. See, Durbin et al., *Biological Sequence Analysis: Probabilistic Models of Proteins and Nucleic Acids*, Cambridge University Press, Cambridge, UK (1998). An HMM is generated by the program HMMER 2.3.2 with default program parameters, using the sequences of the group of functional homologs as input. The multiple sequence alignment is generated by ProbCons (Do et al., Genome Res., 15(2):330-40 (2005)) version 1.11 using a set of default parameters: -c, --consistency REPS of 2; -ir, --iterative-refinement REPS of 100; -pre, --pre-training REPS of 0. ProbCons is a public domain software program provided by Stanford University.

The default parameters for building an HMM (hmmbuild) are as follows: the default "architecture prior" (archpri) used by MAP architecture construction is 0.85, and the default cutoff threshold (idlevel) used to determine the effective sequence number is 0.62. HMMER 2.3.2 was released Oct. 3, 2003 under a GNU general public license, and is available from various sources on the World Wide Web such as hmmer.janelia.org; hmmer.wustl.edu; and fr.com/hmmer232/. Hmmbuild outputs the model as a text file.

The HMM for a group of functional homologs can be used to determine the likelihood that a candidate heat and/or drought-tolerance polypeptide sequence is a better fit to that particular HMM than to a null HMM generated using a group of sequences that are not structurally or functionally related. The likelihood that a candidate polypeptide sequence is a better fit to an HMM than to a null HMM is indicated by the HMM bit score, a number generated when the candidate sequence is fitted to the HMM profile using the HMMER hmmsearch program. The following default parameters are used when running hmmsearch: the default E-value cutoff (E) is 10, the default bit score cutoff (T) is negative infinity, the default number of sequences in a database (Z) is the real number of sequences in the database, the default E-value cutoff for the per-domain ranked hit list (domE) is infinity, and the default bit score cutoff for the per-domain ranked hit list (domT) is negative infinity. A high HMM bit score indicates a greater likelihood that the candidate sequence carries out one or more of the biochemical or physiological function(s) of the polypeptides used to generate the HMM. A high HMM bit score is at least 20, and often is higher. Slight variations in the HMM bit score of a particular sequence can occur due to factors such as the order in which sequences are processed for alignment by multiple sequence alignment algorithms such as the ProbCons program. Nevertheless, such HMM bit score variation is minor.

The heat and/or drought-tolerance polypeptides discussed below fit the indicated HMM with an HMM bit score greater than 20 (e.g., greater than 30, 40, 50, 60, 70, 80, 90, 100, 200, 300, 400, or 500). In some embodiments, the HMM bit score of a heat and/or drought-tolerance polypeptide discussed below is about 50%, 60%, 70%, 80%, 90%, or 95% of the HMM bit score of a functional homolog provided in Sequence Listing. In some embodiments, a heat and/or drought-tolerance polypeptide discussed below fits the indicated HMM with an HMM bit score greater than 20, and has a domain indicative of a heat and/or drought-tolerance polypeptide. In some embodiments, a heat and/or drought-tolerance polypeptide discussed below fits the indicated HMM with an HMM bit score greater than 20, and has 70% or greater sequence identity (e.g., 75%, 80%, 85%, 90%, 95%, or 100% sequence identity) to an amino acid sequence shown in any one of FIGS. 1-16.

Polypeptides are shown in the sequence listing that have HMM bit scores greater than 270 when fitted to an HMM generated from the amino acid sequences set forth in FIG. 1. Such polypeptides include Ceres SEEDLINE ID no. ME00029 (SEQ ID NO:442), Public GI ID no. 72384401 (SEQ ID NO:443), Ceres CLONE ID no. 1079382 (SEQ ID NO:445), Ceres CLONE ID no. 1853461 (SEQ ID NO:447), Ceres CLONE ID no. 1626485 (SEQ ID NO:451), Ceres CLONE ID no. 1713920 (SEQ ID NO:459), Ceres CLONE ID no. 1772747 (SEQ ID NO:463), Ceres CLONE ID no. 225960 (SEQ ID NO:465), Public GI ID no. 115443807 (SEQ ID NO:470), Ceres CLONE ID no. 569388 (SEQ ID NO:483), Ceres CLONE ID no. 1915549 (SEQ ID NO:449), Ceres CLONE ID no. 529871 (SEQ ID NO:453), Ceres CLONE ID no. 1067079 (SEQ ID NO:455), Ceres CLONE ID no. 1079572 (SEQ ID NO:457), Ceres ANNOT ID no. 1456550 (SEQ ID NO:461), Ceres CLONE ID no. 1437889 (SEQ ID NO:469), Ceres CLONE ID no. 2014249 (SEQ ID NO:472), Ceres CLONE ID no. 2033133 (SEQ ID NO:474), Ceres CLONE ID no. 707404 (SEQ ID NO:476), Ceres CLONE ID no. 1770680 (SEQ ID NO:478), Ceres ANNOT ID no. 1450989 (SEQ ID NO:480), Public GI ID no. 72384445 (SEQ ID NO:481), Ceres CLONE ID no. 1059299 (SEQ ID NO:485), and Ceres ANNOT ID no. 6008086 (SEQ ID NO:487).

Polypeptides are shown in the sequence listing that have HMM bit scores greater than 100 when fitted to an HMM generated from the amino acid sequences set forth in FIG. 2. Such polypeptides include Ceres SEEDLINE ID no. ME00045 (SEQ ID NO:489), Ceres CLONE ID no. 571200 (SEQ ID NO:494), Ceres CLONE ID no. 1928532 (SEQ ID NO:496), Ceres ANNOT ID no. 1490637 (SEQ ID NO:498), Ceres CLONE ID no. 295496 (SEQ ID NO:514), Public GI ID no. 115463637 (SEQ ID NO:515), Ceres CLONE ID no. 1999444 (SEQ ID NO:518), Public GI ID no. 147844794 (SEQ ID NO:490), Public GI ID no. 147842279 (SEQ ID NO:491), Public GI ID no. 145355441 (SEQ ID NO:492), Ceres ANNOT ID no. 1461381 (SEQ ID NO:500), Ceres ANNOT ID no. 1440313 (SEQ ID NO:502), Ceres ANNOT ID no. 1448275 (SEQ ID NO:504), Ceres ANNOT ID no. 1437838 (SEQ ID NO:506), Ceres ANNOT ID no. 1501275 (SEQ ID NO:508), Ceres CLONE ID no. 1644562 (SEQ ID NO:510), Ceres CLONE ID no. 1925967 (SEQ ID NO:512), Public GI ID no. 115435904 (SEQ ID NO:516), Public GI ID no. 125552168 (SEQ ID NO:519), Public GI ID no. 125594093 (SEQ ID NO:520), Ceres CLONE ID no. 221188 (SEQ ID NO:522), Ceres ANNOT ID no. 1477714 (SEQ ID NO:524), Ceres CLONE ID no. 1787953 (SEQ ID NO:526), Ceres ANNOT ID no. 1531210 (SEQ ID NO:528), Ceres CLONE ID no. 521176 (SEQ ID NO:530), Public GI ID no. 22327055 (SEQ ID NO:531), Ceres ANNOT ID no. 1508824 (SEQ ID NO:533), Ceres CLONE ID no. 38879 (SEQ ID NO:535), Public GI ID no. 42569309 (SEQ ID NO:536), Ceres CLONE ID no. 1817784 (SEQ ID NO:538), Ceres CLONE ID no. 284637 (SEQ ID NO:540), Public GI ID no. 125596251 (SEQ ID NO:541), Public GI ID no. 125554300 (SEQ ID NO:543), Ceres CLONE ID no. 1935437 (SEQ ID NO:545), Ceres ANNOT ID no. 1455622 (SEQ ID NO:547), Public GI ID no. 55771354 (SEQ ID NO:548), Ceres ANNOT ID no. 1514655 (SEQ ID NO:550), Ceres CLONE ID no. 1848736 (SEQ ID NO:552), Public GI ID no. 125569872 (SEQ ID NO:553), Ceres CLONE ID no. 1645078 (SEQ ID NO:555), Ceres CLONE ID no. 1790573 (SEQ ID NO:557), Public GI ID no. 4567251 (SEQ ID NO:558), Ceres CLONE ID no. 444113 (SEQ ID NO:561), Public GI ID no. 125525355 (SEQ ID NO:562), Ceres ANNOT ID no. 6028854 (SEQ ID NO:564), and Ceres ANNOT ID no. 6115356 (SEQ ID NO:566).

Polypeptides are shown in the sequence listing that have HMM bit scores greater than 150 when fitted to an HMM generated from the amino acid sequences set forth in FIG. 3. Such polypeptides include Ceres SEEDLINE ID no. ME02190 (SEQ ID NO:568), Ceres CLONE ID no. 695006 (SEQ ID NO:578), Ceres ANNOT ID no. 1527488 (SEQ ID NO:584), Public GI ID no. 79318519 (SEQ ID NO:569), Public GI ID no. 79318537 (SEQ ID NO:570), Ceres CLONE ID no. 956998 (SEQ ID NO:572), Ceres CLONE ID no. 978154 (SEQ ID NO:574), Ceres CLONE ID no. 1035628 (SEQ ID NO:576), Ceres CLONE ID no. 464169 (SEQ ID NO:580), Ceres ANNOT ID no. 1474075 (SEQ ID NO:582), Ceres ANNOT ID no. 1474073 (SEQ ID NO:586), and Ceres ANNOT ID no. 1527486 (SEQ ID NO:588).

Polypeptides are shown in the sequence listing that have HMM bit scores greater than 120 when fitted to an HMM generated from the amino acid sequences set forth in FIG. 4. Such polypeptides include Ceres SEEDLINE ID no. ME02549 (SEQ ID NO:590), Ceres ANNOT ID no. 1501305 (SEQ ID NO:623), Ceres CLONE ID no. 607280 (SEQ ID NO:627), Public GI ID no. 92887174 (SEQ ID NO:632), Ceres CLONE ID no. 1857162 (SEQ ID NO:634), Public GI ID no. 115477272 (SEQ ID NO:674), Ceres CLONE ID no. 264002 (SEQ ID NO:682), Public GI ID no. 147822456 (SEQ ID NO:591), Public GI ID no. 144923935 (SEQ ID NO:592), Public GI ID no. 140038730 (SEQ ID NO:593), Public GI ID no. 78708014 (SEQ ID NO:594), Public GI ID no. 115481362 (SEQ ID NO:595), Public GI ID no. 125531350 (SEQ ID NO:596), Public GI ID no. 125525598 (SEQ ID NO:597), Public GI ID no. 77548630 (SEQ ID NO:598), Public GI ID no. 46798895 (SEQ ID NO:599), Public GI ID no. 125564653 (SEQ ID NO:600), Ceres CLONE ID no. 998865 (SEQ ID NO:602), Public GI ID no. 125556140 (SEQ ID NO:603), Public GI ID no. 125534482 (SEQ ID NO:604), Public GI ID no. 125550135 (SEQ ID NO:605), Ceres CLONE ID no. 639816 (SEQ ID NO:607), Public GI ID no. 125562170 (SEQ ID NO:608), Ceres CLONE ID no. 1797059 (SEQ ID NO:610), Ceres CLONE ID no. 1031510 (SEQ ID NO:612), Ceres CLONE ID no. 1973081 (SEQ ID NO:614), Public GI ID no. 125561002 (SEQ ID NO:615), Public GI ID no. 125541732 (SEQ ID NO:616), Public GI ID no. 125560677 (SEQ ID NO:617), Public GI ID no. 125559115 (SEQ ID NO:618), Public GI ID no. 15809903 (SEQ ID NO:619), Public GI ID no. 30681703 (SEQ ID NO:620), Public GI ID no. 9759556 (SEQ ID NO:621), Ceres ANNOT ID no. 1448303 (SEQ ID NO:625), Ceres ANNOT ID no. 1448305 (SEQ ID NO:629), Ceres ANNOT ID no. 1448307 (SEQ ID NO:631), Public GI ID no. 92888243 (SEQ ID NO:635), Public GI ID no. 92879395 (SEQ ID NO:636), Ceres CLONE ID no. 528876 (SEQ ID NO:638), Ceres ANNOT ID no. 1448352 (SEQ ID NO:640), Ceres ANNOT ID no. 1437745 (SEQ ID NO:642), Ceres ANNOT ID no. 1464146 (SEQ ID NO:644), Ceres ANNOT ID no. 1437744 (SEQ ID NO:646), Public GI ID no. 92894684 (SEQ ID NO:647), Ceres CLONE ID no. 3964 (SEQ ID NO:650), Public GI ID no. 13272389 (SEQ ID NO:651), Ceres ANNOT ID no. 1481203 (SEQ ID NO:653), Public GI ID no. 15227699 (SEQ ID NO:654), Public GI ID no. 92886084 (SEQ ID NO:655), Public GI ID no. 15239947 (SEQ ID NO:656), Ceres CLONE ID no.

34878 (SEQ ID NO:658), Ceres CLONE ID no. 150484 (SEQ ID NO:660), Public GI ID no. 21553545 (SEQ ID NO:661), Public GI ID no. 15222843 (SEQ ID NO:662), Public GI ID no. 38230552 (SEQ ID NO:663), Public GI ID no. 3420008 (SEQ ID NO:664), Public GI ID no. 15230602 (SEQ ID NO:665), Public GI ID no. 3420004 (SEQ ID NO:666), Public GI ID no. 2129586 (SEQ ID NO:667), Public GI ID no. 15217849 (SEQ ID NO:668), Public GI ID no. 15227704 (SEQ ID NO:669), Ceres ANNOT ID no. 1465750 (SEQ ID NO:671), Ceres CLONE ID no. 1983975 (SEQ ID NO:673), Public GI ID no. 15226028 (SEQ ID NO:675), Public GI ID no. 115459524 (SEQ ID NO:676), Ceres CLONE ID no. 1793353 (SEQ ID NO:678), Ceres ANNOT ID no. 1467399 (SEQ ID NO:680), Ceres CLONE ID no. 1982930 (SEQ ID NO:684), Public GI ID no. 125540700 (SEQ ID NO:685), Ceres ANNOT ID no. 1448743 (SEQ ID NO:687), Public GI ID no. 50251910 (SEQ ID NO:688), Ceres CLONE ID no. 1836748 (SEQ ID NO:690), Public GI ID no. 3420006 (SEQ ID NO:691), Public GI ID no. 92879376 (SEQ ID NO:692), Ceres CLONE ID no. 838941 (SEQ ID NO:694), Ceres ANNOT ID no. 1437746 (SEQ ID NO:696), Ceres ANNOT ID no. 6017241 (SEQ ID NO:698), Ceres ANNOT ID no. 6085947 (SEQ ID NO:700), and Ceres ANNOT ID no. 6017242 (SEQ ID NO:702).

Polypeptides are shown in the sequence listing that have HMM bit scores greater than 55 when fitted to an HMM generated from the amino acid sequences set forth in FIG. 5. Such polypeptides include Ceres SEEDLINE ID no. ME02865 (SEQ ID NO:705), Public GI ID no. 79320952 (SEQ ID NO:706), Public GI ID no. 79320957 (SEQ ID NO:707), Public GI ID no. 6692094 (SEQ ID NO:708), and Public GI ID no. 145323049 (SEQ ID NO:709).

Polypeptides are shown in the sequence listing that have HMM bit scores greater than 185 when fitted to an HMM generated from the amino acid sequences set forth in FIG. 6. Such polypeptides include Ceres SEEDLINE ID no. ME03227 (SEQ ID NO:711), Ceres CLONE ID no. 964616 (SEQ ID NO:714), Ceres CLONE ID no. 100009667 (SEQ ID NO:715), Ceres ANNOT ID no. 1444568 (SEQ ID NO:719), Ceres CLONE ID no. 719489 (SEQ ID NO:725), Ceres CLONE ID no. 587748 (SEQ ID NO:733), Public GI ID no. 125528114 (SEQ ID NO:734), Ceres CLONE ID no. 274172 (SEQ ID NO:737), Public GI ID no. 144923134 (SEQ ID NO:712), Ceres ANNOT ID no. 1471437 (SEQ ID NO:717), Ceres CLONE ID no. 1270484 (SEQ ID NO:721), Ceres CLONE ID no. 1075098 (SEQ ID NO:723), Public GI ID no. 18412211 (SEQ ID NO:727), Ceres CLONE ID no. 20358 (SEQ ID NO:729), Ceres CLONE ID no. 1915503 (SEQ ID NO:731), Public GI ID no. 115440619 (SEQ ID NO:735), Public GI ID no. 125572387 (SEQ ID NO:738), and Ceres ANNOT ID no. 6015812 (SEQ ID NO:740).

Polypeptides are shown in the sequence listing that have HMM bit scores greater than 110 when fitted to an HMM generated from the amino acid sequences set forth in FIG. 7. Such polypeptides include Ceres SEEDLINE ID no. ME04477 (SEQ ID NO:742), Ceres CLONE ID no. 1620215 (SEQ ID NO: 759); Ceres CLONE ID no. 1798756 (SEQ ID NO: 763); Public GI ID no. 38016527 (SEQ ID NO: 796); Public GI ID no. 75133829 (SEQ ID NO: 799); Ceres ANNOT ID no. 1460527 (SEQ ID NO: 801); Public GI ID no. 119720772 (SEQ ID NO: 857); Ceres CLONE ID no. 708446 (SEQ ID NO: 859); Public GI ID no. 92896423 (SEQ ID NO: 892); Ceres CLONE ID no. 1387149 (SEQ ID NO: 912); Public GI ID no. 5031281 (SEQ ID NO: 953); Ceres CLONE ID no. 1775820 (SEQ ID NO: 955); Public GI ID no. 35187687 (SEQ ID NO: 988); Public GI ID no. 115468934 (SEQ ID NO: 991); Public GI ID no. 118424243 (SEQ ID NO: 1000); Ceres ANNOT ID no. 6063957 (SEQ ID NO: 1010); Public GI ID no. 113196593 (SEQ ID NO: 798); Public GI ID no. 112819496 (SEQ ID NO: 999); Public GI ID no. 147783026 (SEQ ID NO: 743); Public GI ID no. 119367488 (SEQ ID NO: 744); Public GI ID no. 147860340 (SEQ ID NO: 745); Public GI ID no. 115477170 (SEQ ID NO: 757); Ceres CLONE ID no. 1931889 (SEQ ID NO: 761); Ceres CLONE ID no. 1918424 (SEQ ID NO: 767); Ceres CLONE ID no. 1845154 (SEQ ID NO: 771); Ceres Clone ID no. 1084216 (SEQ ID NO: 797); Ceres Annot ID no. 8644540 (SEQ ID NO: 805); Ceres ANNOT ID no. 1450673 (SEQ ID NO: 807); Public GI ID no. 116778802 (SEQ ID NO: 808); Public GI ID no. 116778893 (SEQ ID NO: 809); and Public GI ID no. 116778998 (SEQ ID NO: 810); Public GI ID no. 157849766 (SEQ ID NO: 811); Public GI ID no. 159474166 (SEQ ID NO: 812); Public GI ID no. 168036656 (SEQ ID NO: 813); Ceres ANNOT ID no. 1456578 (SEQ ID NO: 815); Public GI ID no. 168053490 (SEQ ID NO: 816); Public GI ID no. 193237563 (SEQ ID NO: 817); Ceres Clone ID no. 100879386 (SEQ ID NO: 819); Ceres Clone ID no. 2055733 (SEQ ID NO: 823); Ceres Clone ID no. 2056478 (SEQ ID NO: 825); Ceres CLONE ID no. 13007 (SEQ ID NO: 832); Ceres CLONE ID no. 5522 (SEQ ID NO: 834); Ceres CLONE ID no. 30543 (SEQ ID NO: 836); Ceres CLONE ID no. 14203 (SEQ ID NO: 839); Ceres CLONE ID no. 975913 (SEQ ID NO: 846); Ceres CLONE ID no. 967417 (SEQ ID NO: 848); Ceres CLONE ID no. 1614593 (SEQ ID NO: 863); Ceres CLONE ID no. 2025938 (SEQ ID NO: 885); Ceres CLONE ID no. 634261 (SEQ ID NO: 900); Ceres CLONE ID no. 1423851 (SEQ ID NO: 918); Ceres CLONE ID no. 1589047 (SEQ ID NO: 939); Ceres CLONE ID no. 1748922 (SEQ ID NO: 944); Ceres CLONE ID no. 1787151 (SEQ ID NO: 957); Ceres CLONE ID no. 1765871 (SEQ ID NO: 973); Ceres CLONE ID no. 1990071 (SEQ ID NO: 977); Public GI ID no. 125556051 (SEQ ID NO: 989); Public GI ID no. 125561658 (SEQ ID NO: 990); Public GI ID no. 115470773 (SEQ ID NO: 992); Public GI ID no. 115444813 (SEQ ID NO: 993); GI ID no. 169363 (SEQ ID NO: 1215) and Ceres CLONE ID no. 24255 (SEQ ID NO: 1242).

Polypeptides are shown in the sequence listing that have HMM bit scores greater than 215 when fitted to an HMM generated from the amino acid sequences set forth in FIG. 8. Such polypeptides include Ceres SEEDLINE ID no. ME18396 (SEQ ID NO:1012), Ceres CLONE ID no. 287430 (SEQ ID NO:1018), Ceres ANNOT ID no. 451889 (SEQ ID NO:1020), Ceres CLONE ID no. 936084 (SEQ ID NO:1055), Ceres CLONE ID no. 1792501 (SEQ ID NO:1066), Ceres ANNOT ID no. 1437875 (SEQ ID NO:1068), Public GI ID no. 1853968 (SEQ ID NO:1093), Public GI ID no. 27530032 (SEQ ID NO:1094), Ceres CLONE ID no. 1834483 (SEQ ID NO:1110), Public GI ID no. 84579418 (SEQ ID NO:1113), Public GI ID no. 15077030 (SEQ ID NO:1117), Public GI ID no. 13752458 (SEQ ID NO:1118), Public GI ID no. 147865685 (SEQ ID NO:1013), Public GI ID no. 119503368 (SEQ ID NO:1014), Public GI ID no. 72161874 (SEQ ID NO:1015), Public GI ID no. 91780661 (SEQ ID NO:1016), Ceres ANNOT ID no. 835908 (SEQ ID NO:1022), Public GI ID no. 38326750 (SEQ ID NO:1023), Ceres CLONE ID no. 1939396 (SEQ ID NO:1025), Ceres CLONE ID no. 403637 (SEQ ID NO:1027), Public GI ID no. 42539907 (SEQ ID NO:1028), Ceres CLONE ID no. 1836494 (SEQ ID NO:1030), Public GI ID no. 15192945 (SEQ ID NO:1031), Ceres CLONE ID no. 1607947 (SEQ ID NO:1033), Ceres CLONE ID no.

115880 (SEQ ID NO:1035), Ceres CLONE ID no. 1074009 (SEQ ID NO:1037), Ceres CLONE ID no. 476073 (SEQ ID NO:1039), Ceres CLONE ID no. 554053 (SEQ ID NO:1041), Ceres CLONE ID no. 391449 (SEQ ID NO:1045), Ceres CLONE ID no. 1846400 (SEQ ID NO:1048), Ceres ANNOT ID no. 1475185 (SEQ ID NO:1050), Public GI ID no. 115457148 (SEQ ID NO:1051), Ceres ANNOT ID no. 1454960 (SEQ ID NO:1053), Public GI ID no. 50346893 (SEQ ID NO:1056), Ceres CLONE ID no. 1931526 (SEQ ID NO:1058), Ceres ANNOT ID no. 1454260 (SEQ ID NO:1061), Public GI ID no. 115456131 (SEQ ID NO:1062), Ceres CLONE ID no. 159151 (SEQ ID NO:1064), Ceres CLONE ID no. 1842801 (SEQ ID NO:1071), Ceres CLONE ID no. 533030 (SEQ ID NO:1073), Ceres CLONE ID no. 1931881 (SEQ ID NO:1075), Ceres ANNOT ID no. 1480006 (SEQ ID NO:1077), Ceres CLONE ID no. 1895007 (SEQ ID NO:1079), Public GI ID no. 3598863 (SEQ ID NO:1080), Ceres ANNOT ID no. 1471735 (SEQ ID NO:1082), Ceres CLONE ID no. 1937530 (SEQ ID NO:1084), Ceres CLONE ID no. 1833050 (SEQ ID NO:1086), Ceres CLONE ID no. 644213 (SEQ ID NO:1088), Ceres CLONE ID no. 568154 (SEQ ID NO:1090), Ceres CLONE ID no. 527598 (SEQ ID NO:1092), Ceres ANNOT ID no. 1487614 (SEQ ID NO:1096), Ceres ANNOT ID no. 1541881 (SEQ ID NO:1098), Ceres ANNOT ID no. 1488465 (SEQ ID NO:1100), Ceres ANNOT ID no. 1488468 (SEQ ID NO:1102), Ceres ANNOT ID no. 1541884 (SEQ ID NO:1104), Ceres ANNOT ID no. 1454972 (SEQ ID NO:1106), Ceres ANNOT ID no. 1475186 (SEQ ID NO:1108), Ceres CLONE ID no. 686198 (SEQ ID NO:1112), Public GI ID no. 84579420 (SEQ ID NO:1114), Ceres CLONE ID no. 605144 (SEQ ID NO:1116), Public GI ID no. 15077028 (SEQ ID NO:1119), Ceres ANNOT ID no. 1454963 (SEQ ID NO:1121), Ceres ANNOT ID no. 6030208 (SEQ ID NO:1123), and Ceres ANNOT ID no. 6076767 (SEQ ID NO:1125).

Polypeptides are shown in the sequence listing that have HMM bit scores greater than 105 when fitted to an HMM generated from the amino acid sequences set forth in FIG. 9. Such polypeptides include Ceres SEEDLINE ID no. ME20095 (SEQ ID NO:1129), Public GI ID no. 72255610 (SEQ ID NO:933), Ceres SEEDLINE ID no. ME20095 (SEQ ID NO:1129), Ceres CLONE ID no. 1562633 (SEQ ID NO:1140), Ceres ANNOT ID no. 1692728 (SEQ ID NO:1142), Ceres CLONE ID no. 921110 (SEQ ID NO:1144), Ceres CLONE ID no. 1791180 (SEQ ID NO:1146), Ceres CLONE ID no. 527891 (SEQ ID NO:1148), Ceres ANNOT ID no. 1522414 (SEQ ID NO:1150), Public GI ID no. 51458330 (SEQ ID NO:1182), Public GI ID no. 18399940 (SEQ ID NO:63), Ceres ANNOT ID no. 6107929 (SEQ ID NO:73), Ceres ANNOT ID no. 1473094 (SEQ ID NO:96), Ceres ANNOT ID no. 1503955 (SEQ ID NO:127), Ceres ANNOT ID no. 1526501 (SEQ ID NO:139), Public GI ID no. 15235713 (SEQ ID NO:179), Public GI ID no. 15234552 (SEQ ID NO:180), Ceres ANNOT ID no. 1520801 (SEQ ID NO:209), Ceres ANNOT ID no. 1443434 (SEQ ID NO:467), Public GI ID no. 30696058 (SEQ ID NO:559), Ceres ANNOT ID no. 1509601 (SEQ ID NO:648), Ceres ANNOT ID no. 1451912 (SEQ ID NO:726), Ceres ANNOT ID no. 6017545 (SEQ ID NO:741), Ceres ANNOT ID no. 1504999 (SEQ ID NO:765), Ceres ANNOT ID no. 1456402 (SEQ ID NO:773), Ceres ANNOT ID no. 1496359 (SEQ ID NO:781), Ceres ANNOT ID no. 1447260 (SEQ ID NO:842), Ceres ANNOT ID no. 1469023 (SEQ ID NO:861), Ceres ANNOT ID no. 1474186 (SEQ ID NO:865), Ceres ANNOT ID no. 1527596 (SEQ ID NO:867), Ceres CLONE ID no. 1919624 (SEQ ID NO:896), Ceres CLONE ID no. 677797 (SEQ ID NO:916), Public GI ID no. 7960729 (SEQ ID NO:932), Ceres CLONE ID no. 941845 (SEQ ID NO:1043), Public GI ID no. 30683008 (SEQ ID NO:1046), Public GI ID no. 42568786 (SEQ ID NO:1059), Ceres CLONE ID no. 255364 (SEQ ID NO:1069), Public GI ID no. 147771549 (SEQ ID NO:1130), Public GI ID no. 144924741 (SEQ ID NO:1131), Public GI ID no. 121594508 (SEQ ID NO:1132), Public GI ID no. 91202290 (SEQ ID NO:1133), Public GI ID no. 89900939 (SEQ ID NO:1134), Public GI ID no. 77917672 (SEQ ID NO:1135), Public GI ID no. 77165252 (SEQ ID NO:1136), Public GI ID no. 115375374 (SEQ ID NO:1137), Public GI ID no. 110602449 (SEQ ID NO:1138), Public GI ID no. 125540573 (SEQ ID NO:1151), Public GI ID no. 125561519 (SEQ ID NO:1152), Public GI ID no. 125528345 (SEQ ID NO:1153), Public GI ID no. 116310408 (SEQ ID NO:1154), Public GI ID no. 115483332 (SEQ ID NO:1156), Public GI ID no. 125575640 (SEQ ID NO:1157), Public GI ID no. 115476368 (SEQ ID NO:1158), Public GI ID no. 115478841 (SEQ ID NO:1159), Public GI ID no. 115467158 (SEQ ID NO:1160), Public GI ID no. 72384477 (SEQ ID NO:1161), Public GI ID no. 116054703 (SEQ ID NO:1162), Ceres CLONE ID no. 1786317 (SEQ ID NO:1164), Ceres CLONE ID no. 1791336 (SEQ ID NO:1166), Ceres CLONE ID no. 1877752 (SEQ ID NO:1168), Ceres CLONE ID no. 1821191 (SEQ ID NO:1170), Ceres CLONE ID no. 446838 (SEQ ID NO:1172), Ceres CLONE ID no. 1556915 (SEQ ID NO:1174), Public GI ID no. 90200725 (SEQ ID NO:1175), Ceres CLONE ID no. 1580247 (SEQ ID NO:1177), Ceres CLONE ID no. 644201 (SEQ ID NO:1179), Ceres CLONE ID no. 538689 (SEQ ID NO:1181), Ceres CLONE ID no. 817225 (SEQ ID NO:1184), and Ceres CLONE ID no. 923842 (SEQ ID NO:1186).

Polypeptides are shown in the sequence listing that have HMM bit scores greater than 55 when fitted to an HMM generated from the amino acid sequences set forth in FIG. 10. Such polypeptides include Ceres CLONE ID no. 31309 (SEQ ID NO:60), Ceres CLONE ID no. 872030 (SEQ ID NO:62), Ceres CLONE ID no. 100029223 (SEQ ID NO:74), Ceres CLONE ID no. 1939845 (SEQ ID NO:98), Ceres CLONE ID no. 2015383 (SEQ ID NO:102), Ceres CLONE ID no. 1607893 (SEQ ID NO:104), Ceres CLONE ID no. 1075133 (SEQ ID NO:152), Ceres CLONE ID no. 1218065 (SEQ ID NO:915), Public GI ID no. 15227919 (SEQ ID NO:64), Public GI ID no. 9843641 (SEQ ID NO:65), Public GI ID no. 124294789 (SEQ ID NO:66), Public GI ID no. 15233446 (SEQ ID NO:67), Public GI ID no. 115477679 (SEQ ID NO:68), Public GI ID no. 42407552 (SEQ ID NO:69), Public GI ID no. 125562450 (SEQ ID NO:70), Public GI ID no. 115469980 (SEQ ID NO:71), Ceres ANNOT ID no. 1442539 (SEQ ID NO:76), Ceres ANNOT ID no. 1442538 (SEQ ID NO:78), Ceres ANNOT ID no. 1460661 (SEQ ID NO:80), Ceres ANNOT ID no. 1452884 (SEQ ID NO:82), Ceres ANNOT ID no. 1450523 (SEQ ID NO:84), Ceres ANNOT ID no. 1442257 (SEQ ID NO:86), Ceres ANNOT ID no. 1541121 (SEQ ID NO:88), Ceres ANNOT ID no. 1480481 (SEQ ID NO:90), Ceres ANNOT ID no. 1487713 (SEQ ID NO:92), Ceres ANNOT ID no. 1456204 (SEQ ID NO:94), Ceres CLONE ID no. 1387402 (SEQ ID NO:100), Ceres CLONE ID no. 972919 (SEQ ID NO:106), Ceres CLONE ID no. 1645860 (SEQ ID NO:108), Ceres CLONE ID no. 1042804 (SEQ ID NO:110), Ceres CLONE ID no. 1606678 (SEQ ID NO:112), Ceres CLONE ID no. 684496 (SEQ ID NO:114), Ceres CLONE ID no. 1062366 (SEQ ID NO:116), Ceres CLONE ID no. 1722931

(SEQ ID NO:118), Ceres CLONE ID no. 746169 (SEQ ID NO:120), Ceres CLONE ID no. 1050475 (SEQ ID NO:122), Ceres CLONE ID no. 1728904 (SEQ ID NO:124), Ceres CLONE ID no. 1698538 (SEQ ID NO:126), Ceres CLONE ID no. 1762328 (SEQ ID NO:130), Ceres CLONE ID no. 1590072 (SEQ ID NO:132), Ceres CLONE ID no. 471593 (SEQ ID NO:134), Ceres CLONE ID no. 1031667 (SEQ ID NO:136), Ceres CLONE ID no. 1826085 (SEQ ID NO:138), Ceres CLONE ID no. 373932 (SEQ ID NO:142), Ceres CLONE ID no. 1797836 (SEQ ID NO:144), Ceres CLONE ID no. 1102774 (SEQ ID NO:146), Ceres CLONE ID no. 842287 (SEQ ID NO:148), Ceres CLONE ID no. 568205 (SEQ ID NO:150), Ceres ANNOT ID no. 6108997 (SEQ ID NO:154), Ceres ANNOT ID no. 6023609 (SEQ ID NO:156), and Ceres ANNOT ID no. 6017906 (SEQ ID NO:158).

Polypeptides are shown in the sequence listing that have HMM bit scores greater than 55 when fitted to an HMM generated from the amino acid sequences set forth in FIG. 11. Such polypeptides include Ceres LOCUS ID no. At2g26150 (SEQ ID NO:364), Ceres ANNOT ID no. 1455221 (SEQ ID NO:407), Public GI ID no. 729774 (SEQ ID NO:408), Ceres CLONE ID no. 1414288 (SEQ ID NO:410), Public GI ID no. 115482048 (SEQ ID NO:413), Public GI ID no. 56117815 (SEQ ID NO:421), Ceres ANNOT ID no. 1485538 (SEQ ID NO:366), Ceres ANNOT ID no. 1538505 (SEQ ID NO:368), Public GI ID no. 8347238 (SEQ ID NO:369), Public GI ID no. 125542955 (SEQ ID NO:370), Public GI ID no. 115446219 (SEQ ID NO:371), Ceres CLONE ID no. 1597127 (SEQ ID NO:373), Ceres CLONE ID no. 1584568 (SEQ ID NO:375), Ceres CLONE ID no. 286056 (SEQ ID NO:377), Ceres ANNOT ID no. 1543432 (SEQ ID NO:379), Ceres CLONE ID no. 1728062 (SEQ ID NO:381), Ceres ANNOT ID no. 1448950 (SEQ ID NO:383), Ceres CLONE ID no. 771500 (SEQ ID NO:385), Ceres ANNOT ID no. 1485096 (SEQ ID NO:387), Ceres CLONE ID no. 1646104 (SEQ ID NO:389), Public GI ID no. 111184724 (SEQ ID NO:390), Ceres CLONE ID no. 1362475 (SEQ ID NO:392), Ceres CLONE ID no. 597906 (SEQ ID NO:394), Ceres CLONE ID no. 615781 (SEQ ID NO:396), Ceres CLONE ID no. 538713 (SEQ ID NO:398), Ceres CLONE ID no. 1794141 (SEQ ID NO:400), Public GI ID no. 5821138 (SEQ ID NO:401), Public GI ID no. 886742 (SEQ ID NO:402), Ceres CLONE ID no. 1814498 (SEQ ID NO:404), Public GI ID no. 7158882 (SEQ ID NO:405), Ceres ANNOT ID no. 1452564 (SEQ ID NO:412), Public GI ID no. 125557431 (SEQ ID NO:414), Ceres ANNOT ID no. 1442880 (SEQ ID NO:416), Ceres ANNOT ID no. 1463437 (SEQ ID NO:418), Public GI ID no. 42415865 (SEQ ID NO:419), Public GI ID no. 33087081 (SEQ ID NO:420), Public GI ID no. 115521217 (SEQ ID NO:422), Public GI ID no. 115521211 (SEQ ID NO:423), Public GI ID no. 115521215 (SEQ ID NO:424), Ceres ANNOT ID no. 1454376 (SEQ ID NO:426), Ceres CLONE ID no. 835571 (SEQ ID NO:428), Ceres ANNOT ID no. 1500046 (SEQ ID NO:430), Public GI ID no. 110738569 (SEQ ID NO:431), Public GI ID no. 125542510 (SEQ ID NO:432), Public GI ID no. 30686034 (SEQ ID NO:433), Public GI ID no. 125570883 (SEQ ID NO:434), Public GI ID no. 42562463 (SEQ ID NO:435), Ceres CLONE ID no. 100043265 (SEQ ID NO:436), Ceres ANNOT ID no. 6089790 (SEQ ID NO:438), and Ceres ANNOT ID no. 6043635 (SEQ ID NO:440).

Polypeptides are shown in the sequence listing that have HMM bit scores greater than 50 when fitted to an HMM generated from the amino acid sequences set forth in FIG. 12. Such polypeptides include Ceres LOCUS ID no. At1g32330 (SEQ ID NO:311), Ceres ANNOT ID no. 1538958 (SEQ ID NO:319), Public GI ID no. 115521213 (SEQ ID NO:320), Public GI ID no. 42415865 (SEQ ID NO:321), Public GI ID no. 729775 (SEQ ID NO:322), Public GI ID no. 11386827 (SEQ ID NO:323), Public GI ID no. 115456675 (SEQ ID NO:326), Public GI ID no. 89274218 (SEQ ID NO:335), Public GI ID no. 125546035 (SEQ ID NO:312), Ceres CLONE ID no. 125228 (SEQ ID NO:314), Public GI ID no. 115465055 (SEQ ID NO:315), Public GI ID no. 125553080 (SEQ ID NO:316), Public GI ID no. 8920606 (SEQ ID NO:317), Ceres CLONE ID no. 1919643 (SEQ ID NO:325), Public GI ID no. 429155 (SEQ ID NO:327), Ceres CLONE ID no. 1194199 (SEQ ID NO:329), Public GI ID no. 15236631 (SEQ ID NO:330), Ceres ANNOT ID no. 1523420 (SEQ ID NO:332), Ceres ANNOT ID no. 1447046 (SEQ ID NO:334), Public GI ID no. 25296101 (SEQ ID NO:336), Public GI ID no. 15228440 (SEQ ID NO:337), Public GI ID no. 6624612 (SEQ ID NO:338), Public GI ID no. 125588688 (SEQ ID NO:339), Public GI ID no. 115470859 (SEQ ID NO:340), Public GI ID no. 15228865 (SEQ ID NO:341), Ceres CLONE ID no. 1571069 (SEQ ID NO:343), Public GI ID no. 115455903 (SEQ ID NO:344), Ceres ANNOT ID no. 1459422 (SEQ ID NO:346), Ceres CLONE ID no. 1577511 (SEQ ID NO:348), Public GI ID no. 115451657 (SEQ ID NO:349), Public GI ID no. 15225255 (SEQ ID NO:350), Public GI ID no. 125545695 (SEQ ID NO:351), Ceres ANNOT ID no. 1471817 (SEQ ID NO:353), Ceres ANNOT ID no. 1440896 (SEQ ID NO:355), Public GI ID no. 119393868 (SEQ ID NO:356), Ceres ANNOT ID no. 1517025 (SEQ ID NO:358), Ceres ANNOT ID no. 1512410 (SEQ ID NO:360), and Ceres ANNOT ID no. 6035498 (SEQ ID NO:362).

Polypeptides are shown in the sequence listing that have HMM bit scores greater than 25 when fitted to an HMM generated from the amino acid sequences set forth in FIG. 13. Such polypeptides include Ceres CLONE ID no. 41543 (SEQ ID NO:160) Ceres CLONE ID no. 1837065 (SEQ ID NO:162), Ceres ANNOT ID no. 1531178 (SEQ ID NO:184), Ceres CLONE ID no. 470694 (SEQ ID NO:242), Public GI ID no. 92867368 (SEQ ID NO:253), Ceres CLONE ID no. 859707 (SEQ ID NO:256), Ceres CLONE ID no. 392275 (SEQ ID NO:268), Ceres CLONE ID no. 1828394 (SEQ ID NO:282), Public GI ID no. 115466694 (SEQ ID NO:294), Ceres CLONE ID no. 1895763 (SEQ ID NO:164), Ceres CLONE ID no. 1850460 (SEQ ID NO:166), Ceres CLONE ID no. 1808074 (SEQ ID NO:168), Ceres CLONE ID no. 1832882 (SEQ ID NO:170), Ceres CLONE ID no. 1978977 (SEQ ID NO:172), Ceres CLONE ID no. 1918742 (SEQ ID NO:174), Ceres CLONE ID no. 1940023 (SEQ ID NO:176), Ceres CLONE ID no. 1923495 (SEQ ID NO:178), Ceres CLONE ID no. 1851388 (SEQ ID NO:182), Ceres ANNOT ID no. 1477681 (SEQ ID NO:186), Ceres ANNOT ID no. 1508800 (SEQ ID NO:188), Ceres ANNOT ID no. 1455597 (SEQ ID NO:190), Ceres ANNOT ID no. 1532016 (SEQ ID NO:192), Ceres ANNOT ID no. 1478526 (SEQ ID NO:194), Ceres ANNOT ID no. 1492567 (SEQ ID NO:196), Ceres ANNOT ID no. 1515273 (SEQ ID NO:198), Ceres ANNOT ID no. 1461979 (SEQ ID NO:200), Ceres ANNOT ID no. 1439702 (SEQ ID NO:202), Ceres ANNOT ID no. 1448044 (SEQ ID NO:204), Ceres ANNOT ID no. 1483370 (SEQ ID NO:206), Ceres ANNOT ID no. 1445651 (SEQ ID NO:208), Ceres ANNOT ID no. 1490863 (SEQ ID NO:212), Ceres ANNOT ID no. 1501043 (SEQ ID NO:214), Ceres ANNOT ID no. 1527507 (SEQ ID NO:216), Ceres ANNOT ID no. 1498633 (SEQ ID NO:218), Ceres ANNOT ID no. 1465403 (SEQ ID NO:220), Ceres ANNOT ID no. 1510956 (SEQ ID NO:222), Ceres ANNOT ID no. 1457735 (SEQ ID NO:224), Public GI ID no. 15224711 (SEQ ID NO:225), Ceres CLONE ID no. 40062 (SEQ ID NO:228), Public GI ID no. 15220315 (SEQ ID NO:229), Ceres CLONE ID no. 36480 (SEQ ID NO:231), Ceres CLONE ID no. 2443 (SEQ ID NO:233), Public GI ID no. 30685375 (SEQ ID NO:234), Public GI ID no. 126009434 (SEQ ID NO:235), Ceres CLONE ID no. 965753 (SEQ ID NO:237), Ceres CLONE ID no. 948834 (SEQ ID NO:239), Public GI ID no. 33347409 (SEQ ID NO:240), Ceres CLONE ID no. 643614 (SEQ ID NO:244), Ceres CLONE ID no. 1049362 (SEQ ID NO:246), Ceres CLONE ID no. 546675 (SEQ ID NO:248), Ceres CLONE ID no. 522046 (SEQ ID NO:250), Ceres CLONE ID no. 651076 (SEQ ID NO:252), Public GI ID no. 92897590 (SEQ ID NO:254), Ceres CLONE ID no. 634176 (SEQ ID NO:258), Ceres CLONE ID no. 1041432 (SEQ ID NO:260), Ceres CLONE ID no. 1065203 (SEQ ID NO:262), Ceres CLONE ID no. 555361 (SEQ ID NO:264), Ceres CLONE ID no. 704227 (SEQ ID NO:266), Ceres CLONE ID no. 100819945 (SEQ ID NO:269), Ceres CLONE ID no. 282584 (SEQ ID NO:271), Ceres CLONE ID no. 1448469 (SEQ ID NO:273), Ceres CLONE ID no. 241246 (SEQ ID NO:275), Ceres CLONE ID no. 234443 (SEQ ID NO:277), Ceres CLONE ID no. 293549 (SEQ ID NO:279), Public GI ID no. 109450926 (SEQ ID NO:280), Ceres CLONE ID no. 1803923 (SEQ ID NO:284), Ceres CLONE ID no. 2024557 (SEQ ID NO:286), Ceres CLONE ID no. 1820364 (SEQ ID NO:288), Public GI ID no. 125554274 (SEQ ID NO:289), Public GI ID no. 125531165 (SEQ ID NO:290), Public GI ID no. 125541514 (SEQ ID NO:291), Public GI ID no. 125557559 (SEQ ID NO:292), Public GI ID no. 125557844 (SEQ ID NO:293), Public GI ID no. 115449295 (SEQ ID NO:295), Public GI ID no. 115481182 (SEQ ID NO:296), Public GI ID no. 20177639 (SEQ ID NO:297), Public GI ID no. 115471021 (SEQ ID NO:298), Public GI ID no. 115456011 (SEQ ID NO:299), Public GI ID no. 125588290 (SEQ ID NO:300), Public GI ID no. 115477799 (SEQ ID NO:301), Public GI ID no. 115471385 (SEQ ID NO:302), Public GI ID no. 125599705 (SEQ ID NO:303), Public GI ID no. 115489810 (SEQ ID NO:304), Public GI ID no. 55276718 (SEQ ID NO:305), Ceres ANNOT ID no. 6025568 (SEQ ID NO:307), and Ceres ANNOT ID no. 6091128 (SEQ ID NO:309).

Polypeptides are shown in the sequence listing that have HMM bit scores greater than 85 when fitted to an HMM generated from the amino acid sequences set forth in FIG. 14. Such polypeptides include Ceres CLONE ID no. 14572 (SEQ ID NO:2), Public GI ID no. 115470807 (SEQ ID NO:5), Ceres CLONE ID no. 1842931 (SEQ ID NO:15), Ceres CLONE ID no. 321308 (SEQ ID NO:17), Ceres CLONE ID no. 1725811 (SEQ ID NO:19), Ceres CLONE ID no. 1357455 (SEQ ID NO:21), Ceres CLONE ID no. 943370 (SEQ ID NO:23), Ceres CLONE ID no. 1327712 (SEQ ID NO:25), Ceres CLONE ID no. 1764692 (SEQ ID NO:27), Ceres ANNOT ID no. 1512656 (SEQ ID NO:41), Public GI ID no. 18403425 (SEQ ID NO:3), Public GI ID no. 11994285 (SEQ ID NO:4), Public GI ID no. 108706298 (SEQ ID NO:6), Public GI ID no. 15233585 (SEQ ID NO:7), Public GI ID no. 125599279 (SEQ ID NO:8), Public GI ID no. 115450865 (SEQ ID NO:9), Public GI ID no. 22773244 (SEQ ID NO:10), Public GI ID no. 92874749 (SEQ ID NO:11), Ceres CLONE ID no. 1857034 (SEQ ID NO:13), Ceres CLONE ID no. 1059300 (SEQ ID NO:29), Ceres CLONE ID no. 1804869 (SEQ ID NO:31), Ceres CLONE ID no. 378863 (SEQ ID NO:33), Ceres CLONE ID no. 1930271 (SEQ ID NO:35), Ceres CLONE ID no. 2034728 (SEQ ID NO:37), Ceres CLONE ID no. 1866421 (SEQ ID NO:39), Ceres ANNOT ID no. 1463492 (SEQ ID NO:43), Ceres ANNOT ID no. 1459391 (SEQ ID NO:45), Ceres ANNOT ID no. 1442920 (SEQ ID NO:47), Ceres ANNOT ID no. 6011447 (SEQ ID NO:49), Ceres ANNOT ID no. 6068218 (SEQ ID NO:51), Ceres ANNOT ID no. 6044121 (SEQ ID NO:53), and Ceres ANNOT ID no. 6100755 (SEQ ID NO:55).

Polypeptides are shown in the sequence listing that have HMM bit scores greater than 70 when fitted to an HMM generated from the amino acid sequences set forth in FIG. 15. Such polypeptides include Ceres SEEDLINE ID no. ME02401 (SEQ ID NO:749), Ceres CLONE ID no. 1847516 (SEQ ID NO:1195), Ceres CLONE ID no. 1961986 (SEQ ID NO:1201), Ceres ANNOT ID no. 6091930 (SEQ ID NO:1207), Ceres CLONE ID no. 2025938 (SEQ ID NO:885), Ceres CLONE ID no. 1821214 (SEQ ID NO:1189), Ceres CLONE ID no. 1040399 (SEQ ID NO:1191), Ceres CLONE ID no. 1093691 (SEQ ID NO:1193), Ceres CLONE ID no. 974539 (SEQ ID NO:1197), Ceres CLONE ID no. 1832340 (SEQ ID NO:1199), Ceres CLONE ID no. 1933211 (SEQ ID NO:1203), Ceres CLONE ID no. 997558 (SEQ ID NO:1205), Ceres ANNOT ID no. 6041596 (SEQ ID NO:1209), Public GI ID no. 125564176 (SEQ ID NO:1210), Ceres CLONE ID no. 1836064 (SEQ ID NO:1212), Ceres CLONE ID no. 1909693 (SEQ ID NO:1214), Public GI ID no. 169363 (SEQ ID NO:1215), Public GI ID no. 40287480 (SEQ ID NO:1216), Ceres CLONE ID no. 1765346 (SEQ ID NO:1218), Public GI ID no. 125546008 (SEQ ID NO:1219), Ceres CLONE ID no. 1950900 (SEQ ID NO:1221), Public GI ID no. 41350259 (SEQ ID NO:1222), Public GI ID no. 125588210 (SEQ ID NO:1223), Ceres CLONE ID no. 1954395 (SEQ ID NO:1225), Public GI ID no. 18403408 (SEQ ID NO:1226), Ceres CLONE ID no. 2010121 (SEQ ID NO:1228), Ceres ANNOT ID no. 6011486 (SEQ ID NO:1230), Public GI ID no. 25082726 (SEQ ID NO:1231), Public GI ID no. 113196593 (SEQ ID NO:1232), Ceres CLONE ID no. 1843021 (SEQ ID NO:1234), Ceres CLONE ID no. 1931194 (SEQ ID NO:1236), Ceres CLONE ID no. 1652996 (SEQ ID NO:1238), Ceres CLONE ID no. 1930044 (SEQ ID NO:1240), Ceres CLONE ID no. 24255 (SEQ ID NO:1242), Ceres ANNOT ID no. 6034955 (SEQ ID NO:1244), Ceres ANNOT ID no. 6119444 (SEQ ID NO:1246), Ceres ANNOT ID no. 6063956 (SEQ ID NO:1248), Ceres ANNOT ID no. 6015461 (SEQ ID NO:1250), Ceres CLONE ID no. 696244 (SEQ ID NO:1252), Ceres ANNOT ID no. 1468973 (SEQ ID NO:1254), Ceres CLONE ID no. 2019529 (SEQ ID NO:1256), and Ceres CLONE ID no. 1492169 (SEQ ID NO:1258).

Polypeptides are shown in the sequence listing that have HMM bit scores greater than about 300 when fitted to an HMM generated from the amino acid sequences set forth in FIG. 16. Such polypeptides include Ceres SEEDLINE ID no. ME004246 (SEQ ID NO: 1311), CeresClone:971761 (SEQ ID NO: 1313), CeresClone:1946574 (SEQ ID NO: 1331), CeresClone:2055551 (SEQ ID NO: 1340), CeresClone:100045499 (SEQ ID NO: 1347), CeresClone:1465853 (SEQ ID NO: 1353), CeresClone:753982 (SEQ ID NO: 1360), CeresClone:1076093 (SEQ ID NO: 1315), CeresClone:1627875 (SEQ ID NO: 1317), CeresAnnot:1508362 (SEQ ID NO: 1319), CeresAnnot:1526950 (SEQ ID NO: 1321), CeresClone:1832333 (SEQ ID NO: 1323), GI:74272607 (SEQ ID NO: 1324), GI:192910782 (SEQ ID NO: 1325), GI:157342563 (SEQ ID NO: 1326), GI:159483497 (SEQ ID NO: 1327), CeresClone:1839999 (SEQ ID NO: 1329), CeresClone:467335 (SEQ ID NO: 1333), GI:168010087 (SEQ ID NO: 1334), CeresClone:

1728202 (SEQ ID NO: 1336), CeresClone:1994239 (SEQ ID NO: 1338), CeresAnnot:8704704 (SEQ ID NO: 1342), GI:115453877 (SEQ ID NO: 1343), CeresClone:1646411 (SEQ ID NO: 1345), CeresClone:100920260 (SEQ ID NO: 1349), GI:116786147 (SEQ ID NO: 1350), GI:116783944 (SEQ ID NO: 1351), GI:82623397 (SEQ ID NO: 1354), CeresAnnot:8656662 (SEQ ID NO: 1356), CeresClone: 1417803 (SEQ ID NO: 1358), and GI:145345927 (SEQ ID NO: 1361).

D. Percent Identity

In some embodiments, a heat and/or drought-tolerance polypeptide has an amino acid sequence with at least 20% sequence identity, e.g., 21%, 22%, 24%, 27%, 30%, 33%, 38%, 45%, 46%, 49%, 50%, 52%, 56%, 59%, 61%, 65%, 70%, 75%, 80%, 85%, 90%, 95%, 97%, 98%, or 99% sequence identity, to one of the amino acid sequences set forth in SEQ ID NO:442, SEQ ID NO:489, SEQ ID NO:568, SEQ ID NO:590, SEQ ID NO:705, SEQ ID NO:711, SEQ ID NO:742, SEQ ID NO:1012, SEQ ID NO:1129, SEQ ID NO:60, SEQ ID NO:364, SEQ ID NO:311, SEQ ID NO:160, SEQ ID NO:2, SEQ ID NO:749, SEQ ID NO: 1131, and SEQ ID NO:57. Polypeptides having such a percent sequence identity often have a domain indicative of a heat and/or drought-tolerance polypeptide and/or have an HMM bit score that is greater than 20, as discussed above. Amino acid sequences of heat and/or drought-tolerance polypeptides having at least 20% sequence identity to one of the amino acid sequences set forth in SEQ ID NO:442, SEQ ID NO:489, SEQ ID NO:568, SEQ ID NO:590, SEQ ID NO:705, SEQ ID NO:711, SEQ ID NO:742, SEQ ID NO:1012, SEQ ID NO:1129, SEQ ID NO:60, SEQ ID NO:364, SEQ ID NO:311, SEQ ID NO:160, SEQ ID NO:2, SEQ ID NO: 1131, and SEQ ID NO:749 are provided in FIGS. 1-16.

"Percent sequence identity" refers to the degree of sequence identity between any given reference sequence, e.g., SEQ ID NO:2, and a candidate heat and/or drought-tolerance sequence. A candidate sequence typically has a length that is from 80 percent to 200 percent of the length of the reference sequence, e.g., 82, 85, 87, 89, 90, 93, 95, 97, 99, 100, 105, 110, 115, 120, 130, 140, 150, 160, 170, 180, 190, or 200 percent of the length of the reference sequence. A percent identity for any candidate nucleic acid or polypeptide relative to a reference nucleic acid or polypeptide can be determined as follows. A reference sequence (e.g., a nucleic acid sequence or an amino acid sequence) is aligned to one or more candidate sequences using the computer program ClustalW (version 1.83, default parameters), which allows alignments of nucleic acid or polypeptide sequences to be carried out across their entire length (global alignment). Chenna et al., Nucleic Acids Res., 31(13):3497-500 (2003).

ClustalW calculates the best match between a reference and one or more candidate sequences, and aligns them so that identities, similarities and differences can be determined. Gaps of one or more residues can be inserted into a reference sequence, a candidate sequence, or both, to maximize sequence alignments. For fast pairwise alignment of nucleic acid sequences, the following default parameters are used: word size: 2; window size: 4; scoring method: percentage; number of top diagonals: 4; and gap penalty: 5. For multiple alignment of nucleic acid sequences, the following parameters are used: gap opening penalty: 10; gap extension penalty: 5.0; and weight transitions: yes. For fast pairwise alignment of protein sequences, the following parameters are used: word size: 1; window size: 5; scoring method: percentage; number of top diagonals: 5; gap penalty: 3. For multiple alignment of protein sequences, the following parameters are used: weight matrix: blosum; gap opening penalty: 10; gap extension penalty: 0.5; hydrophilic gaps: on; hydrophilic residues: Gly, Pro, Ser, Asn, Asp, Gln, Glu, Arg, and Lys; residue-specific gap penalties: on. The ClustalW output is a sequence alignment that reflects the relationship between sequences. ClustalW can be run, for example, at the Baylor College of Medicine Search Launcher site (searchlauncher.bcm.tmc.edu/multi-align/multi-align.html) and at the European Bioinformatics Institute site on the World Wide Web (ebi.ac.uk/clustalw).

To determine percent identity of a candidate nucleic acid or amino acid sequence to a reference sequence, the sequences are aligned using ClustalW, the number of identical matches in the alignment is divided by the length of the reference sequence, and the result is multiplied by 100. It is noted that the percent identity value can be rounded to the nearest tenth. For example, 78.11, 78.12, 78.13, and 78.14 are rounded down to 78.1, while 78.15, 78.16, 78.17, 78.18, and 78.19 are rounded up to 78.2.

In some cases, a drought-tolerance polypeptide has an amino acid sequence with at least 40% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:442. Amino acid sequences of polypeptides having greater than 40% sequence identity to the polypeptide set forth in SEQ ID NO:442 are provided in FIG. 1. Such polypeptides include Public GI ID no. 72384401 (SEQ ID NO:443), Ceres CLONE ID no. 1079382 (SEQ ID NO:445), Ceres CLONE ID no. 1853461 (SEQ ID NO:447), Ceres CLONE ID no. 1626485 (SEQ ID NO:451), Ceres CLONE ID no. 1713920 (SEQ ID NO:459), Ceres CLONE ID no. 1772747 (SEQ ID NO:463), Ceres CLONE ID no. 225960 (SEQ ID NO:465), Public GI ID no. 115443807 (SEQ ID NO:470), and Ceres CLONE ID no. 569388 (SEQ ID NO:483).

In some cases, a drought-tolerance polypeptide has an amino acid sequence with at least 30% sequence identity, e.g., 30%, 35%, 40%, 48%, 50%, 52%, 56%, 59%, 61%, 65%, 70%, 75%, 80%, 85%, 90%, 95%, 97%, 98%, or 99% sequence identity, to the amino acid sequence set forth in SEQ ID NO:489 Amino acid sequences of polypeptides having greater than 30% sequence identity to the polypeptide set forth in SEQ ID NO:489 are provided in FIG. 2. Such polypeptides include Ceres CLONE ID no. 571200 (SEQ ID NO:494), Ceres CLONE ID no. 1928532 (SEQ ID NO:496), Ceres ANNOT ID no. 1490637 (SEQ ID NO:498), Ceres CLONE ID no. 295496 (SEQ ID NO:514), Public GI ID no. 115463637 (SEQ ID NO:515), and Ceres CLONE ID no. 1999444 (SEQ ID NO:518).

In some cases, a drought-tolerance polypeptide has an amino acid sequence with at least 35% sequence identity, e.g., 37%, 40%, 45%, 50%, 52%, 56%, 59%, 61%, 65%, 70%, 75%, 80%, 85%, 90%, 95%, 97%, 98%, or 99% sequence identity, to the amino acid sequence set forth in SEQ ID NO:568. Amino acid sequences of polypeptides having greater than 35% sequence identity to the polypeptide set forth in SEQ ID NO:568 are provided in FIG. 3. Such polypeptides include Ceres CLONE ID no. 695006 (SEQ ID NO:578) and Ceres ANNOT ID no. 1527488 (SEQ ID NO:584).

In some cases, a drought-tolerance polypeptide has an amino acid sequence with at least 25% sequence identity, e.g., 28%, 32%, 40%, 44%, 48%, 50%, 52%, 56%, 59%, 61%, 65%, 70%, 75%, 80%, 85%, 90%, 95%, 97%, 98%, or 99% sequence identity, to the amino acid sequence set forth in SEQ ID NO:590. Amino acid sequences of polypeptides having greater than 25% sequence identity to the polypeptide set forth in SEQ ID NO:590 are provided in FIG. 4. Such polypeptides include Ceres ANNOT ID no. 1501305 (SEQ ID NO:623), Ceres CLONE ID no. 607280 (SEQ ID NO:627), Public GI ID no. 92887174 (SEQ ID NO:632), Ceres CLONE ID no. 1857162 (SEQ ID NO:634), Public GI ID no. 115477272 (SEQ ID NO:674), and Ceres CLONE ID no. 264002 (SEQ ID NO:682).

In some cases, a drought-tolerance polypeptide has an amino acid sequence with at least 40% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO:705. Amino acid sequences of polypeptides having greater than 40% sequence identity to the polypeptide set forth in SEQ ID NO:705 are provided in FIG. 5. Such polypeptides include Public GI ID no. 79320952 (SEQ ID NO:706) and Public GI ID no. 79320957 (SEQ ID NO:707).

In some cases, a drought-tolerance polypeptide has an amino acid sequence with at least 30% sequence identity, e.g., 33%, 41%, 45%, 50%, 52%, 56%, 59%, 61%, 65%, 70%, 75%, 80%, 85%, 90%, 95%, 97%, 98%, or 99% sequence identity, to the amino acid sequence set forth in SEQ ID NO:711. Amino acid sequences of polypeptides having greater than 30% sequence identity to the polypeptide set forth in SEQ ID NO:711 are provided in FIG. 6. Such polypeptides include Ceres CLONE ID no. 964616 (SEQ ID NO:714), Ceres CLONE ID no. 100009667 (SEQ ID NO:715), Ceres ANNOT ID no. 1444568 (SEQ ID NO:719), Ceres CLONE ID no. 719489 (SEQ ID NO:725), Ceres CLONE ID no. 587748 (SEQ ID NO:733), Public GI ID no. 125528114 (SEQ ID NO:734), and Ceres CLONE ID no. 274172 (SEQ ID NO:737).

In some cases, a drought-tolerance polypeptide has an amino acid sequence with at least 30% sequence identity, e.g., 35%, 38%, 43%, 47%, 50%, 52%, 56%, 59%, 61%, 65%, 70%, 75%, 80%, 85%, 90%, 95%, 97%, 98%, or 99% sequence identity, to the amino acid sequence set forth in SEQ ID NO:742 Amino acid sequences of polypeptides having greater than 30% sequence identity to the polypeptide set forth in SEQ ID NO:742 are provided in FIG. 7. Such polypeptides include Public GI ID no. 115477170 (SEQ ID NO:757), Ceres CLONE ID no. 1620215 (SEQ ID NO:759), Ceres CLONE ID no. 1931889 (SEQ ID NO:761), Ceres ANNOT ID no. 1460527 (SEQ ID NO:801), Ceres CLONE ID no. 975913 (SEQ ID NO:846), Ceres CLONE ID no. 708446 (SEQ ID NO:859), Ceres CLONE ID no. 1748922 (SEQ ID NO:944), Ceres CLONE ID no. 1775820 (SEQ ID NO:955), Public GI ID no. 115468934 (SEQ ID NO:991), and Public GI ID no. 118424243 (SEQ ID NO:1000).

In some cases, a drought-tolerance polypeptide has an amino acid sequence with at least 35% sequence identity, e.g., 36%, 40%, 47%, 50%, 52%, 56%, 59%, 61%, 65%, 70%, 75%, 80%, 85%, 90%, 95%, 97%, 98%, or 99% sequence identity, to the amino acid sequence set forth in SEQ ID NO:1012 Amino acid sequences of polypeptides having greater than 35% sequence identity to the polypeptide set forth in SEQ ID NO:1012 are provided in FIG. 8. Such polypeptides include Ceres CLONE ID no. 287430 (SEQ ID NO:1018), Ceres ANNOT ID no. 451889 (SEQ ID NO:1020), Ceres CLONE ID no. 936084 (SEQ ID NO:1055), Ceres CLONE ID no. 1792501 (SEQ ID NO:1066), Ceres ANNOT ID no. 1437875 (SEQ ID NO:1068), Public GI ID no. 1853968 (SEQ ID NO:1093), Public GI ID no. 27530032 (SEQ ID NO:1094), Ceres CLONE ID no. 1834483 (SEQ ID NO:1110), Public GI ID no. 84579418 (SEQ ID NO:1113), Public GI ID no. 15077030 (SEQ ID NO:1117), and Public GI ID no. 13752458 (SEQ ID NO:1118).

In some cases, a drought-tolerance polypeptide has an amino acid sequence with at least 30% sequence identity, e.g., 31%, 35%, 40%, 41%, 49%, 50%, 52%, 56%, 59%, 61%, 65%, 70%, 75%, 80%, 85%, 90%, 95%, 97%, 98%, or 99% sequence identity, to the amino acid sequence set forth in SEQ ID NO:1129 Amino acid sequences of polypeptides having greater than 30% sequence identity to the polypeptide set forth in SEQ ID NO:1129 are provided in FIG. 9. Such polypeptides include Public GI ID no. 72255610 (SEQ ID NO:933), Ceres SEEDLINE ID no. ME20095 (SEQ ID NO:1129), Ceres CLONE ID no. 1562633 (SEQ ID NO:1140), Ceres ANNOT ID no. 1692728 (SEQ ID NO:1142), Ceres CLONE ID no. 921110 (SEQ ID NO:1144), Ceres CLONE ID no. 1791180 (SEQ ID NO:1146), Ceres CLONE ID no. 527891 (SEQ ID NO:1148), Ceres ANNOT ID no. 1522414 (SEQ ID NO:1150), and Public GI ID no. 51458330 (SEQ ID NO:1182). In some cases, a heat-tolerance polypeptide has an amino acid sequence with at least 25% sequence identity, e.g., 26%, 27%, 30%, 32%, 40%, 42%, 47%, 50%, 52%, 56%, 59%, 61%, 65%, 70%, 75%, 80%, 85%, 90%, 95%, 97%, 98%, or 99% sequence identity, to the amino acid sequence set forth in SEQ ID NO:60 Amino acid sequences of polypeptides having greater than 25% sequence identity to the polypeptide set forth in SEQ ID NO:60 are provided in FIG. 10. Such polypeptides include Ceres CLONE ID no. 872030 (SEQ ID NO:62), Ceres CLONE ID no. 100029223 (SEQ ID NO:74), Ceres CLONE ID no. 1939845 (SEQ ID NO:98), Ceres CLONE ID no. 2015383 (SEQ ID NO:102), Ceres CLONE ID no. 1607893 (SEQ ID NO:104), Ceres CLONE ID no. 1075133 (SEQ ID NO:152), and Ceres CLONE ID no. 1218065 (SEQ ID NO:915).

In some cases, a heat-tolerance polypeptide has an amino acid sequence with at least 25% sequence identity, e.g., 27%, 28%, 31%, 36%, 44%, 50%, 52%, 56%, 59%, 61%, 65%, 70%, 75%, 80%, 85%, 90%, 95%, 97%, 98%, or 99% sequence identity, to the amino acid sequence set forth in SEQ ID NO:364 Amino acid sequences of polypeptides having greater than 25% sequence identity to the polypeptide set forth in SEQ ID NO:364 are provided in FIG. 11. Such polypeptides include Ceres ANNOT ID no. 1455221 (SEQ ID NO:407), Public GI ID no. 729774 (SEQ ID NO:408), Ceres CLONE ID no. 1414288 (SEQ ID NO:410), Public GI ID no. 115482048 (SEQ ID NO:413), and Public GI ID no. 56117815 (SEQ ID NO:421).

In some cases, a heat-tolerance polypeptide has an amino acid sequence with at least 25% sequence identity, e.g., 29%, 35%, 40%, 47%, 50%, 52%, 56%, 59%, 61%, 65%, 70%, 75%, 80%, 85%, 90%, 95%, 97%, 98%, or 99% sequence identity, to the amino acid sequence set forth in SEQ ID NO:311. Amino acid sequences of polypeptides having greater than 25% sequence identity to the polypeptide set forth in SEQ ID NO:311 are provided in FIG. 12. Such polypeptides include Ceres ANNOT ID no. 1538958 (SEQ ID NO:319), Public GI ID no. 115521213 (SEQ ID NO:320), Public GI ID no. 42415865 (SEQ ID NO:321), Public GI ID no. 729775 (SEQ ID NO:322), Public GI ID no. 11386827 (SEQ ID NO:323), Public GI ID no. 115456675 (SEQ ID NO:326), and Public GI ID no. 89274218 (SEQ ID NO:335).

In some cases, a heat-tolerance polypeptide has an amino acid sequence with at least 25% sequence identity, e.g., 30%, 33%, 40%, 45%, 50%, 52%, 56%, 59%, 61%, 65%, 70%, 75%, 80%, 85%, 90%, 95%, 97%, 98%, or 99% sequence identity, to the amino acid sequence set forth in SEQ ID NO:160. Amino acid sequences of polypeptides having greater than 25% sequence identity to the polypeptide set forth in SEQ ID NO:160 are provided in FIG. 13. Such polypeptides include Ceres CLONE ID no. 1837065 (SEQ ID NO:162), Ceres ANNOT ID no. 1531178 (SEQ ID NO:184), Ceres CLONE ID no. 470694 (SEQ ID NO:242), Public GI ID no. 92867368 (SEQ ID NO:253), Ceres CLONE ID no. 859707 (SEQ ID NO:256), Ceres CLONE ID no. 392275 (SEQ ID NO:268), Ceres CLONE ID no. 1828394 (SEQ ID NO:282), and Public GI ID no. 115466694 (SEQ ID NO:294).

In some cases, a heat-tolerance polypeptide has an amino acid sequence with at least 20% sequence identity, e.g., 21%, 22%, 30%, 35%, 40%, 45%, 50%, 52%, 56%, 59%, 61%, 65%, 70%, 75%, 80%, 85%, 90%, 95%, 97%, 98%, or 99% sequence identity, to the amino acid sequence set forth in SEQ ID NO:2. Amino acid sequences of polypeptides having greater than 20% sequence identity to the polypeptide set forth in SEQ ID NO:2 are provided in FIG. 14. Such polypeptides include Public GI ID no. 115470807 (SEQ ID NO:5), Ceres CLONE ID no. 1842931 (SEQ ID NO:15), Ceres CLONE ID no. 321308 (SEQ ID NO:17), Ceres CLONE ID no. 1725811 (SEQ ID NO:19), Ceres CLONE ID no. 1357455 (SEQ ID NO:21), Ceres CLONE ID no. 943370 (SEQ ID NO:23), Ceres CLONE ID no. 1327712 (SEQ ID NO:25), Ceres CLONE ID no. 1764692 (SEQ ID NO:27), and Ceres ANNOT ID no. 1512656 (SEQ ID NO:41).

In some cases, a drought-tolerance polypeptide has an amino acid sequence with at least 20% sequence identity, e.g., 22%, 23%, 30%, 35%, 40%, 50%, 52%, 56%, 59%, 61%, 65%, 70%, 75%, 80%, 85%, 90%, 95%, 97%, 98%, or 99% sequence identity, to the amino acid sequence set forth in SEQ ID NO:749. Amino acid sequences of polypeptides having greater than 20% sequence identity to the polypeptide set forth in SEQ ID NO:749 are provided in FIG. 15. Such polypeptides include Ceres CLONE ID no. 1847516 (SEQ ID NO:1195), Ceres CLONE ID no. 1961986 (SEQ ID NO:1201), and Ceres ANNOT ID no. 6091930 (SEQ ID NO:1207).

In some cases, a drought-tolerance polypeptide has an amino acid sequence with at least 30% sequence identity, e.g., 31%, 35%, 40%, 41%, 49%, 50%, 52%, 56%, 59%, 61%, 65%, 70%, 75%, 80%, 85%, 90%, 95%, 97%, 98%, or 99% sequence identity, to the amino acid sequence set forth in SEQ ID NO:1311 Amino acid sequences of polypeptides having greater than 30% sequence identity to the polypeptide set forth in SEQ ID NO:1311 are provided in FIG. 16. Such polypeptides include CeresClone:971761 (SEQ ID NO: 1313), CeresClone:1946574 (SEQ ID NO: 1331), CeresClone:2055551 (SEQ ID NO: 1340), CeresClone:100045499 (SEQ ID NO: 1347), CeresClone:1465853 (SEQ ID NO: 1353), CeresClone:753982 (SEQ ID NO: 1360), CeresClone:1076093 (SEQ ID NO: 1315), CeresClone:1627875 (SEQ ID NO: 1317), CeresAnnot:1508362 (SEQ ID NO: 1319), CeresAnnot:1526950 (SEQ ID NO: 1321), CeresClone:1832333 (SEQ ID NO: 1323), GI:74272607 (SEQ ID NO: 1324), GI:192910782 (SEQ ID NO: 1325), GI:157342563 (SEQ ID NO: 1326), GI:159483497 (SEQ ID NO: 1327), CeresClone:1839999 (SEQ ID NO: 1329), CeresClone:467335 (SEQ ID NO: 1333), GI:168010087 (SEQ ID NO: 1334), CeresClone:1728202 (SEQ ID NO: 1336), CeresClone:1994239 (SEQ ID NO: 1338), CeresAnnot:8704704 (SEQ ID NO: 1342), GI:115453877 (SEQ ID NO: 1343), CeresClone:1646411 (SEQ ID NO: 1345), CeresClone:100920260 (SEQ ID NO: 1349), GI:116786147 (SEQ ID NO: 1350), GI:116783944 (SEQ ID NO: 1351), GI:82623397 (SEQ ID NO: 1354), CeresAnnot:8656662 (SEQ ID NO: 1356), CeresClone:1417803 (SEQ ID NO: 1358), and GI:145345927 (SEQ ID NO: 1361).

E. Other Sequences

It should be appreciated that a heat and/or drought-tolerance polypeptide can include additional amino acids that are not involved in heat and/or drought-tolerance, and thus such a polypeptide can be longer than would otherwise be the case. For example, a heat and/or drought-tolerance polypeptide can include a purification tag, a chloroplast transit peptide, a mitochondrial transit peptide, an amyloplast peptide, or a leader sequence added to the amino or carboxy terminus. In some embodiments, a heat and/or drought-tolerance polypeptide includes an amino acid sequence that functions as a reporter, e.g., a green fluorescent protein or yellow fluorescent protein.

III. NUCLEIC ACIDS

Nucleic acids described herein include nucleic acids that are effective to increase heat and/or drought tolerance when transcribed in a plant or plant cell. Such nucleic acids include those that encode a heat and/or drought-tolerance polypeptide.

A. Nucleic Acids Encoding Heat and/or Drought-Tolerance Polypeptides

Nucleic acids encoding heat and/or drought-tolerance polypeptides are described herein. Such nucleic acids include SEQ ID NO:441, SEQ ID NO:488, SEQ ID NO:567, SEQ ID NO:589, SEQ ID NO:703, SEQ ID NO:704, SEQ ID NO:710, SEQ ID NO:1241, SEQ ID NO:1260, SEQ ID NO:1126, SEQ ID NO:1127, SEQ ID NO:1128, SEQ ID NO:58, SEQ ID NO:59, SEQ ID NO:363, SEQ ID NO:310, SEQ ID NO:159, SEQ ID NO:1, and SEQ ID NO:56, as described in more detail below. A nucleic acid also can be a fragment that is at least 40% (e.g., at least 45, 50, 55, 60, 65, 70, 75, 80, 85, 90, 95, or 99%) of the length of the full-length nucleic acid set forth in SEQ ID NO:441, SEQ ID NO:488, SEQ ID NO:567, SEQ ID NO:589, SEQ ID NO:703, SEQ ID NO:704, SEQ ID NO:710, SEQ ID NO:1241, SEQ ID NO:1260, SEQ ID NO:1126, SEQ ID NO:1127, SEQ ID NO:1128, SEQ ID NO:58, SEQ ID NO:59, SEQ ID NO:363, SEQ ID NO:310, SEQ ID NO:159, SEQ ID NO:1, SEQ ID NO:1008, and SEQ ID NO:56.

A drought-tolerance nucleic acid can comprise the nucleotide sequence set forth in SEQ ID NO:441. Alternatively, a drought-tolerance nucleic acid can be a variant of the nucleic acid having the nucleotide sequence set forth in SEQ ID NO:441. For example, a drought-tolerance nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:441 or a functional homolog thereof such as those identified in the sequence listing.

A drought-tolerance nucleic acid can comprise the nucleotide sequence set forth in SEQ ID NO:488. Alternatively, a drought-tolerance nucleic acid can be a variant of the nucleic acid having the nucleotide sequence set forth in SEQ ID NO:488. For example, a drought-tolerance nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:488 or a functional homolog thereof such as those identified in the sequence listing.

A drought-tolerance nucleic acid can comprise the nucleotide sequence set forth in SEQ ID NO:567. Alternatively, a drought-tolerance nucleic acid can be a variant of the nucleic acid having the nucleotide sequence set forth in SEQ ID NO:567. For example, a drought-tolerance nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:567 or a functional homolog thereof such as those identified in the sequence listing.

A drought-tolerance nucleic acid can comprise the nucleotide sequence set forth in SEQ ID NO:589. Alternatively, a drought-tolerance nucleic acid can be a variant of the nucleic acid having the nucleotide sequence set forth in SEQ ID NO:589. For example, a drought-tolerance nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:589 or a functional homolog thereof such as those identified in the sequence listing.

A drought-tolerance nucleic acid can comprise the nucleotide sequence set forth in SEQ ID NO:703. Alternatively, a drought-tolerance nucleic acid can be a variant of the nucleic acid having the nucleotide sequence set forth in SEQ ID NO:703. For example, a drought-tolerance nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:703 or a functional homolog thereof such as those identified in the sequence listing.

A drought-tolerance nucleic acid can comprise the nucleotide sequence set forth in SEQ ID NO:710. Alternatively, a drought-tolerance nucleic acid can be a variant of the nucleic acid having the nucleotide sequence set forth in SEQ ID NO:710. For example, a drought-tolerance nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:710 or a functional homolog thereof such as those identified in the sequence listing.

A drought-tolerance nucleic acid can comprise the nucleotide sequence set forth in SEQ ID NO:1241. Alternatively, a drought-tolerance nucleic acid can be a variant of the nucleic acid having the nucleotide sequence set forth in SEQ ID NO:1241. For example, a drought-tolerance nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:1241 or a functional homolog thereof such as those identified in the sequence listing.

A drought-tolerance nucleic acid can comprise the nucleotide sequence set forth in SEQ ID NO:1260. Alternatively, a drought-tolerance nucleic acid can be a variant of the nucleic acid having the nucleotide sequence set forth in SEQ ID NO:1260. For example, a drought-tolerance nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:1260 or a functional homolog thereof such as those identified in the sequence listing.

A drought-tolerance nucleic acid can comprise the nucleotide sequence set forth in SEQ ID NO:1126. Alternatively, a drought-tolerance nucleic acid can be a variant of the nucleic acid having the nucleotide sequence set forth in SEQ ID NO:1126. For example, a drought-tolerance nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:1126 or a functional homolog thereof such as those identified in the sequence listing.

A heat-tolerance nucleic acid can comprise the nucleotide sequence set forth in SEQ ID NO:58. Alternatively, a heat-tolerance nucleic acid can be a variant of the nucleic acid having the nucleotide sequence set forth in SEQ ID NO:58. For example, a heat-tolerance nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:58 or a functional homolog thereof such as those identified in the sequence listing.

A heat-tolerance nucleic acid can comprise the nucleotide sequence set forth in SEQ ID NO:363. Alternatively, a heat-tolerance nucleic acid can be a variant of the nucleic acid having the nucleotide sequence set forth in SEQ ID NO:363. For example, a heat-tolerance nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:363 or a functional homolog thereof such as those identified in the sequence listing.

A heat-tolerance nucleic acid can comprise the nucleotide sequence set forth in SEQ ID NO:310. Alternatively, a heat-tolerance nucleic acid can be a variant of the nucleic acid having the nucleotide sequence set forth in SEQ ID NO:310. For example, a heat-tolerance nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:310 or a functional homolog thereof such as those identified in the sequence listing.

A heat-tolerance nucleic acid can comprise the nucleotide sequence set forth in SEQ ID NO:159. Alternatively, a heat-tolerance nucleic acid can be a variant of the nucleic acid having the nucleotide sequence set forth in SEQ ID NO:159. For example, a heat-tolerance nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:159 or a functional homolog thereof such as those identified in the sequence listing.

A heat-tolerance nucleic acid can comprise the nucleotide sequence set forth in SEQ ID NO:1. Alternatively, a heat-tolerance nucleic acid can be a variant of the nucleic acid having the nucleotide sequence set forth in SEQ ID NO:1. For example, a heat-tolerance nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:1 or a functional homolog thereof such as those identified in the sequence listing.

A drought-tolerance nucleic acid can comprise the nucleotide sequence set forth in SEQ ID NO:1008. Alternatively, a drought-tolerance nucleic acid can be a variant of the nucleic acid having the nucleotide sequence set forth in SEQ ID NO:1008. For example, a drought-tolerance nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:1008 or a functional homolog thereof such as those identified in the sequence listing.

A heat-tolerance nucleic acid can comprise the nucleotide sequence set forth in SEQ ID NO:56. Alternatively, a heat-tolerance nucleic acid can be a variant of the nucleic acid having the nucleotide sequence set forth in SEQ ID NO:56. For example, a heat-tolerance nucleic acid can have a nucleotide sequence with at least 80% sequence identity, e.g., 81%, 85%, 90%, 95%, 97%, 98%, or 99% sequence identity, to the nucleotide sequence set forth in SEQ ID NO:56.

A drought-tolerance nucleic acid can comprise the nucleotide sequence set forth in SEQ ID NO:1362. Alternatively, a drought-tolerance nucleic acid can be a variant of the nucleic acid having the nucleotide sequence set forth in SEQ ID NO:1362. For example, a drought-tolerance nucleic acid can have a nucleotide sequence with at least 30% sequence identity, e.g., 35%, 40%, 45%, 50%, 55%, 60%, 65%, 70%, 75%, 80%, 85%, 90%, 95%, 97%, 98%, or 99% sequence identity, to the nucleotide sequence set forth in SEQ ID NO:1362 or a functional homolog thereof such as those identified in the sequence listing.

Isolated nucleic acid molecules can be produced by standard techniques. For example, polymerase chain reaction (PCR) techniques can be used to obtain an isolated nucleic acid containing a nucleotide sequence described herein. PCR can be used to amplify specific sequences from DNA as well as RNA, including sequences from total genomic DNA or total cellular RNA. Various PCR methods are described, for example, in *PCR Primer: A Laboratory Manual*, Dieffenbach and Dveksler, eds., Cold Spring Harbor Laboratory Press, 1995. Generally, sequence information from the ends of the region of interest or beyond is employed to design oligonucleotide primers that are identical or similar in sequence to opposite strands of the template to be amplified. Various PCR strategies also are available by which site-specific nucleotide sequence modifications can be introduced into a template nucleic acid. Isolated nucleic acids also can be chemically synthesized, either as a single nucleic acid molecule (e.g., using automated DNA synthesis in the 3' to 5' direction using phosphoramidite technology) or as a series of oligonucleotides. For example, one or more pairs of long oligonucleotides (e.g., >100 nucleotides) can be synthesized that contain the desired sequence, with each pair containing a short segment of complementarity (e.g., about 15 nucleotides) such that a duplex is formed when the oligonucleotide pair is annealed. DNA polymerase is used to extend the oligonucleotides, resulting in a single, double-stranded nucleic acid molecule per oligonucleotide pair, which then can be ligated into a vector. Isolated nucleic acids of the invention also can be obtained by mutagenesis of, e.g., a naturally occurring DNA.

B. Use of Nucleic Acids to Modulate Expression of Polypeptides

Expression of a Heat and/or Drought-Tolerance Polypeptide

A nucleic acid encoding one of the heat and/or drought-tolerance polypeptides described herein can be used to express the polypeptide in a plant species of interest, typically by transforming a plant cell with a nucleic acid having the coding sequence for the polypeptide operably linked in sense orientation to one or more regulatory regions. Suitable polynucleotides include full-length nucleic acids encoding heat and/or drought-tolerance polypeptides or fragments of such full-length nucleic acids. In some embodiments, a complement of the full-length nucleic acid or a fragment thereof can be used. Typically, a fragment is at least 50 nucleotides, e.g., at least 50, 55, 60, 75, 100, 200, 300, 500, 600, 700, 1000, 2000 nucleotides or more.

It will be appreciated that because of the degeneracy of the genetic code, a number of nucleic acids can encode a particular heat and/or drought-tolerance polypeptide; i.e., for many amino acids, there is more than one nucleotide triplet that serves as the codon for the amino acid. Thus, codons in the coding sequence for a given heat and/or drought-tolerance polypeptide can be modified such that optimal expression in a particular plant species is obtained, using appropriate codon bias tables for that species.

In some cases, expression of a heat and/or drought-tolerance polypeptide inhibits one or more functions of an endogenous polypeptide. For example, a nucleic acid that encodes a dominant negative polypeptide can be used to inhibit protein function. A dominant negative polypeptide typically is mutated or truncated relative to an endogenous wild type polypeptide, and its presence in a cell inhibits one or more functions of the wild type polypeptide in that cell, i.e., the dominant negative polypeptide is genetically dominant and confers a loss of function. The mechanism by which a dominant negative polypeptide confers such a phenotype can vary but often involves a protein-protein interaction or a protein-DNA interaction. For example, a dominant negative polypeptide can be an enzyme that is truncated relative to a native wild type enzyme, such that the truncated polypeptide retains domains involved in binding a first protein but lacks domains involved in binding a second protein. The truncated polypeptide is thus unable to properly modulate the activity of the second protein. See, e.g., US 2007/0056058. As another example, a point mutation that results in a non-conservative amino acid substitution in a catalytic domain can result in a dominant negative polypeptide. See, e.g., US 2005/032221. As another example, a dominant negative polypeptide can be a transcription factor that is truncated relative to a native wild type transcription factor, such that the truncated polypeptide retains the DNA binding domain(s) but lacks the activation domain(s). Such a truncated polypeptide can inhibit the wild type transcription factor from binding DNA, thereby inhibiting transcription activation.

C. Constructs/Vectors

Recombinant constructs provided herein can be used to transform plants or plant cells in order to increase drought and/or heat tolerance. A recombinant nucleic acid construct can comprise a nucleic acid encoding a heat and/or drought-tolerance polypeptide as described herein, operably linked to a regulatory region suitable for expressing the heat and/or drought-tolerance polypeptide in the plant or cell. Thus, a nucleic acid can comprise a coding sequence that encodes any of the heat and/or drought-tolerance polypeptides as set forth in SEQ ID NO: 2, 3, 4, 5, 6, 7, 8, 9, 10, 11, 13, 15, 17, 19, 21, 23, 25, 27, 29, 31, 33, 35, 37, 39, 41, 43, 45, 47, 49, 51, 53, 55, 57, 60, 62, 63, 64, 65, 66, 67, 68, 69, 70, 71, 73, 74, 76, 78, 80, 82, 84, 86, 88, 90, 92, 94, 96, 98, 100, 102, 104, 106, 108, 110, 112, 114, 116, 118, 120, 122, 124, 126, 127, 130, 132, 134, 136, 138, 139, 142, 144, 146, 148, 150, 152, 154, 156, 158, 160, 162, 164, 166, 168, 170, 172, 174, 176, 178, 179, 180, 182, 184, 186, 188, 190, 192, 194, 196, 198, 200, 202, 204, 206, 208, 209, 212, 214, 216, 218, 220, 222, 224, 225, 228, 229, 231, 233, 234, 235, 237, 239, 240, 242, 244, 246, 248, 250, 252, 253, 254, 256, 258, 260, 262, 264, 266, 268, 269, 271, 273, 275, 277, 279, 280, 282, 284, 286, 288, 289, 290, 291, 292, 293, 294, 295, 296, 297, 298, 299, 300, 301, 302, 303, 304, 305, 307, 309, 311, 312, 314, 315, 316, 317, 319, 320, 321, 322, 323, 325, 326, 327, 329, 330, 332, 334, 335, 336, 337, 338, 339, 340, 341, 343, 344, 346, 348, 349, 350, 351, 353, 355, 356, 358, 360, 362, 364, 366, 368, 369, 370, 371, 373, 375, 377, 379, 381, 383, 385, 387, 389, 390, 392, 394, 396, 398, 400, 401, 402, 404, 405, 407, 408, 410, 412, 413, 414, 416, 418, 419, 420, 421, 422, 423, 424, 426, 428, 430, 431, 432, 433, 434, 435, 436, 438, 440, 442, 443, 445, 447, 449, 451, 453, 455, 457, 459, 461, 463, 465, 467, 469, 470, 472, 474, 476, 478, 480, 481, 483, 485, 487, 489, 490, 491, 492, 494, 496, 498, 500, 502, 504, 506, 508, 510, 512, 514, 515, 516, 518, 519, 520, 522, 524, 526, 528, 530, 531, 533, 535, 536, 538, 540, 541, 543, 545, 547, 548, 550, 552, 553, 555, 557, 558, 559, 561, 562, 564, 566, 568, 569, 570, 572, 574, 576, 578, 580, 582, 584, 586, 588, 590, 591, 592, 593, 594, 595, 596, 597, 598, 599, 600, 602, 603, 604, 605, 607, 608, 610, 612, 614, 615, 616, 617, 618, 619, 620, 621, 623, 625, 627, 629, 631, 632, 634, 635, 636, 638, 640, 642, 644, 646, 647, 648, 650, 651, 653, 654, 655, 656, 658, 660, 661, 662, 663, 664, 665, 666, 667, 668, 669, 671, 673, 674, 675, 676, 678, 680, 682, 684, 685, 687, 688, 690, 691, 692, 694, 696, 698, 700, 702, 705, 706, 707, 708, 709, 711, 712, 714, 715, 717, 719, 721, 723, 725, 726, 727, 729, 731, 733, 734, 735, 737, 738, 740, 741, 742, 743, 744, 745, 746, 747, 748, 749, 751, 752, 753, 754, 755, 756, 757, 759, 760, 761, 763, 765, 767, 768, 769, 771, 773, 774, 775, 777, 779, 781, 783, 785, 787, 789, 791, 793, 795, 796, 797, 798, 799, 801, 803, 805, 807, 808, 809, 810, 811, 812, 813, 815, 816, 817, 819, 821, 823, 825, 827, 829, 832, 834, 836, 839, 840, 841, 842, 843, 844, 845, 846, 848, 849, 850, 851, 852, 853, 854, 856, 857, 859, 861, 863, 865, 867, 869, 870, 871, 872, 873, 874, 876, 878, 880, 882, 885, 886, 887, 888, 889, 890, 891, 892, 893, 894, 896, 897, 898, 900, 901, 902, 904, 906, 908, 910, 912, 913, 914, 915, 916, 918, 920, 922, 924, 926, 929, 931, 932, 933, 935, 937, 939, 941, 943, 944, 945, 947, 949, 951, 952, 953, 955, 957, 958, 959, 960, 961, 962, 963, 964, 966, 968, 969, 970, 971, 973, 974, 975, 977, 978, 979, 980, 981, 983, 985, 987, 988, 989, 990, 991, 992, 993, 995, 997, 998, 999, 1000, 1001, 1003, 1005, 1007, 1010, 1012, 1013, 1014, 1015, 1016, 1018, 1020, 1022, 1023, 1025, 1027, 1028, 1030, 1031, 1033, 1035, 1037, 1039, 1041, 1043, 1045, 1046, 1048, 1050, 1051, 1053, 1055, 1056, 1058, 1059, 1061, 1062, 1064, 1066, 1068, 1069, 1071, 1073, 1075, 1077, 1079, 1080, 1082, 1084, 1086, 1088, 1090, 1092, 1093, 1094, 1096, 1098, 1100, 1102, 1104, 1106, 1108, 1110, 1112, 1113, 1114, 1116, 1117, 1118, 1119, 1121, 1123, 1125, 1129, 1130, 1131, 1132, 1133, 1134, 1135, 1136, 1137, 1138, 1140, 1142, 1144, 1146, 1148, 1150, 1151, 1152, 1153, 1154, 1156, 1157, 1158, 1159, 1160, 1161, 1162, 1164, 1166, 1168, 1170, 1172, 1174, 1175, 1177, 1179, 1181, 1182, 1184, 1186, 1188, 1189, 1191, 1193, 1195, 1197, 1199, 1201, 1203, 1205, 1207, 1209, 1210, 1212, 1214, 1215, 1216, 1218, 1219, 1221, 1222, 1223, 1225, 1226, 1228, 1230, 1231, 1232, 1234, 1236, 1238, 1240, 1242, 1244, 1246, 1248, 1250, 1252, 1254, 1256, 1258, 1262, 1264, 1265, 1267, 1269, 1271, 1273, 1274, 1276, 1277, 1279, 1281, 1283, 1285, 1286, 1287, 1288, 1290, 1292, 1293, 1294, 1296, 1298, 1300, 1302, 1304, 1305, 1311, 1313, 1315, 1317, 1319, 1321, 1323, 1324, 1325, 1326, 1327, 1329, 1331, 1333, 1334, 1336, 1338, 1340, 1342, 1343, 1345, 1347, 1349, 1350, 1351, 1353, 1354, 1356, 1358, 1360, or 1361. The heat and/or drought-tolerance polypeptide encoded by a recombinant nucleic acid can be a native heat and/or drought-tolerance polypeptide, or can be heterologous to the cell. Examples of suitable regulatory regions are described in the section entitled "Regulatory Regions."

Vectors containing recombinant nucleic acid constructs such as those described herein also are provided. Suitable vector backbones include, for example, those routinely used in the art such as plasmids, viruses, artificial chromosomes, BACs, YACs, or PACs. Suitable expression vectors include, without limitation, plasmids and viral vectors derived from, for example, bacteriophage, baculoviruses, and retroviruses. Numerous vectors and expression systems are commercially available from such corporations as Novagen (Madison, Wis.), Clontech (Palo Alto, Calif.), Stratagene (La Jolla, Calif.), and Invitrogen/Life Technologies (Carlsbad, Calif.).

The vectors provided herein also can include, for example, origins of replication, scaffold attachment regions (SARs), and/or markers. A marker gene can confer a selectable phenotype on a plant cell. For example, a marker can confer biocide resistance, such as resistance to an antibiotic (e.g., kanamycin, G418, bleomycin, or hygromycin), or an herbicide (e.g., glyphosate, chlorsulfuron or phosphinothricin). In addition, an expression vector can include a tag sequence designed to facilitate manipulation or detection (e.g., purification or localization) of the expressed polypeptide. Tag sequences, such as luciferase, β-glucuronidase (GUS), green fluorescent protein (GFP), glutathione S-transferase (GST), polyhistidine, c-myc, hemagglutinin, or Flag™ tag (Kodak, New Haven, Conn.) sequences typically are expressed as a fusion with the encoded polypeptide. Such tags can be inserted anywhere within the polypeptide, including at either the carboxyl or amino terminus.

D. Regulatory Regions

The choice of regulatory regions to be included in a recombinant construct depends upon several factors, including, but not limited to, efficiency, selectability, inducibility, desired expression level, and cell- or tissue-preferential expression. It is a routine matter for one of skill in the art to modulate the expression of a coding sequence by appropriately selecting and positioning regulatory regions relative to the coding sequence. Transcription of a nucleic acid can be modulated in a similar manner.

Some suitable regulatory regions initiate transcription only, or predominantly, in certain cell types. Methods for identifying and characterizing regulatory regions in plant genomic DNA are known, including, for example, those described in the following references: Jordano et al., *Plant Cell*, 1:855-866 (1989); Bustos et al., *Plant Cell*, 1:839-854 (1989); Green et al., *EMBO J.*, 7:4035-4044 (1988); Meier et al., *Plant Cell*, 3:309-316 (1991); and Zhang et al., *Plant Physiology*, 110:1069-1079 (1996).

Examples of various classes of regulatory regions are described below. Some of the regulatory regions indicated below as well as additional regulatory regions are described in more detail in U.S. Patent Application Ser. Nos. 60/505,689; 60/518,075; 60/544,771; 60/558,869; 60/583,691; 60/619,181; 60/637,140; 60/757,544; 60/776,307; 10/957,569; 11/058,689; 11/172,703; 11/208,308; 11/274,890; 60/583,609; 60/612,891; 11/097,589; 11/233,726; 11/408,791; 11/414,142; 10/950,321; 11/360,017; PCT/US05/011105; PCT/US05/23639; PCT/US05/034308; PCT/US05/034343; and PCT/US06/038236; PCT/US06/040572; and PCT/US07/62762.

For example, the sequences of regulatory regions p326, YP0144, YP0190, p13879, YP0050, p32449, 21876, YP0158, YP0214, YP0380, PT0848, PT0633, YP0128, YP0275, PT0660, PT0683, PT0758, PT0613, PT0672, PT0688, PT0837, YP0092, PT0676, PT0708, YP0396, YP0007, YP0111, YP0103, YP0028, YP0121, YP0008, YP0039, YP0115, YP0119, YP0120, YP0374, YP0101, YP0102, YP0110, YP0117, YP0137, YP0285, YP0212, YP0097, YP0107, YP0088, YP0143, YP0156, PT0650, PT0695, PT0723, PT0838, PT0879, PT0740, PT0535, PT0668, PT0886, PT0585, YP0381, YP0337, PT0710, YP0356, YP0385, YP0384, YP0286, YP0377, PD1367, PT0863, PT0829, PT0665, PT0678, YP0086, YP0188, YP0263, PT0743 and YP0096 are set forth in the sequence listing of PCT/US06/040572; the sequence of regulatory region PT0625 is set forth in the sequence listing of PCT/US05/034343; the sequences of regulatory regions PT0623, YP0388, YP0087, YP0093, YP0108, YP0022 and YP0080 are set forth in the sequence listing of U.S. patent application Ser. No. 11/172,703; the sequence of regulatory region PR0924 is set forth in the sequence listing of PCT/US07/62762; and the sequences of regulatory regions p530c10, pOsFIE2-2, pOsMEA, pOsYp102, and pOsYp285 are set forth in the sequence listing of PCT/US06/038236.

It will be appreciated that a regulatory region may meet criteria for one classification based on its activity in one plant species, and yet meet criteria for a different classification based on its activity in another plant species.

i. Broadly Expressing Promoters

A promoter can be said to be "broadly expressing" when it promotes transcription in many, but not necessarily all, plant tissues. For example, a broadly expressing promoter can promote transcription of an operably linked sequence in one or more of the shoot, shoot tip (apex), and leaves, but weakly or not at all in tissues such as roots or stems. As another example, a broadly expressing promoter can promote transcription of an operably linked sequence in one or more of the stem, shoot, shoot tip (apex), and leaves, but can promote transcription weakly or not at all in tissues such as reproductive tissues of flowers and developing seeds. Non-limiting examples of broadly expressing promoters that can be included in the nucleic acid constructs provided herein include the p326, YP0144, YP0190, p13879, YP0050, p32449, 21876, YP0158, YP0214, YP0380, PT0848, and PT0633 promoters. Additional examples include the cauliflower mosaic virus (CaMV) 35S promoter, the mannopine synthase (MAS) promoter, the 1' or 2' promoters derived from T-DNA of *Agrobacterium tumefaciens*, the figwort mosaic virus 34S promoter, actin promoters such as the rice actin promoter, and ubiquitin promoters such as the maize ubiquitin-1 promoter. In some cases, the CaMV 35S promoter is excluded from the category of broadly expressing promoters.

ii. Root Promoters

Root-active promoters confer transcription in root tissue, e.g., root endodermis, root epidermis, or root vascular tissues. In some embodiments, root-active promoters are root-preferential promoters, i.e., confer transcription only or predominantly in root tissue. Root-preferential promoters include the YP0128, YP0275, PT0625, PT0660, PT0683, and PT0758 promoters. Other root-preferential promoters include the PT0613, PT0672, PT0688, and PT0837 promoters, which drive transcription primarily in root tissue and to a lesser extent in ovules and/or seeds. Other examples of root-preferential promoters include the root-specific subdomains of the CaMV 35S promoter (Lam et al., *Proc. Natl. Acad. Sci. USA*, 86:7890-7894 (1989)), root cell specific promoters reported by Conkling et al., *Plant Physiol.*, 93:1203-1211 (1990), and the tobacco RD2 promoter.

iii. Maturing Endosperm Promoters

In some embodiments, promoters that drive transcription in maturing endosperm can be useful. Transcription from a maturing endosperm promoter typically begins after fertilization and occurs primarily in endosperm tissue during seed development and is typically highest during the cellularization phase. Most suitable are promoters that are active predominantly in maturing endosperm, although promoters that are also active in other tissues can sometimes be used. Non-limiting examples of maturing endosperm promoters that can be included in the nucleic acid constructs provided herein include the napin promoter, the Arcelin-5 promoter, the phaseolin promoter (Bustos et al., *Plant Cell*, 1(9):839-853 (1989)), the soybean trypsin inhibitor promoter (Riggs et al., *Plant Cell*, 1(6):609-621 (1989)), the ACP promoter (Baerson et al., *Plant Mol. Biol.*, 22(2):255-267 (1993)), the stearoyl-ACP desaturase promoter (Slocombe et al., *Plant Physiol.*, 104(4):167-176 (1994)), the soybean α' subunit of β-conglycinin promoter (Chen et al., *Proc. Natl. Acad. Sci. USA*, 83:8560-8564 (1986)), the oleosin promoter (Hong et al., *Plant Mol. Biol.*, 34(3):549-555 (1997)), and zein promoters, such as the 15 kD zein promoter, the 16 kD zein promoter, 19 kD zein promoter, 22 kD zein promoter and 27 kD zein promoter. Also suitable are the Osgt-1 promoter from the rice glutelin-1 gene (Zheng et al., *Mol. Cell Biol.*, 13:5829-5842 (1993)), the beta-amylase promoter, and the barley hordein promoter. Other maturing endosperm promoters include the YP0092, PT0676, and PT0708 promoters.

iv. Ovary Tissue Promoters

Promoters that are active in ovary tissues such as the ovule wall and mesocarp can also be useful, e.g., a polygalacturonidase promoter, the banana TRX promoter, the melon actin promoter, YP0396, and PT0623. Examples of promoters that are active primarily in ovules include YP0007, YP0111, YP0092, YP0103, YP0028, YP0121, YP0008, YP0039, YP0115, YP0119, YP0120, and YP0374.

v. Embryo Sac/Early Endosperm Promoters

To achieve expression in embryo sac/early endosperm, regulatory regions can be used that are active in polar nuclei and/or the central cell, or in precursors to polar nuclei, but not in egg cells or precursors to egg cells. Most suitable are promoters that drive expression only or predominantly in polar nuclei or precursors thereto and/or the central cell. A pattern of transcription that extends from polar nuclei into early endosperm development can also be found with embryo sac/early endosperm-preferential promoters, although transcription typically decreases significantly in later endosperm development during and after the cellularization phase. Expression in the zygote or developing embryo typically is not present with embryo sac/early endosperm promoters.

Promoters that may be suitable include those derived from the following genes: *Arabidopsis* viviparous-1 (see, GenBank No. U93215); *Arabidopsis* atmyc1 (see, Urao (1996) *Plant Mol. Biol.*, 32:571-57; Conceicao (1994) *Plant*, 5:493-505); *Arabidopsis* FIE (GenBank No. AF129516); *Arabidopsis* MEA; *Arabidopsis* FIS2 (GenBank No. AF096096); and FIE 1.1 (U.S. Pat. No. 6,906,244). Other promoters that may be suitable include those derived from the following genes: maize MAC1 (see, Sheridan (1996) *Genetics*, 142: 1009-1020); maize Cat3 (see, GenBank No. L05934; Abler (1993) *Plant Mol. Biol.*, 22:10131-1038). Other promoters include the following *Arabidopsis* promoters: YP0039, YP0101, YP0102, YP0110, YP0117, YP0119, YP0137, DME, YP0285, and YP0212. Other promoters that may be useful include the following rice promoters: p530c10, pOsFIE2-2, pOsMEA, pOsYp102, and pOsYp285.

vi. Embryo Promoters

Regulatory regions that preferentially drive transcription in zygotic cells following fertilization can provide embryo-preferential expression. Most suitable are promoters that preferentially drive transcription in early stage embryos prior to the heart stage, but expression in late stage and maturing embryos is also suitable. Embryo-preferential promoters include the barley lipid transfer protein (Ltp1) promoter (*Plant Cell Rep* (2001) 20:647-654), YP0097, YP0107, YP0088, YP0143, YP0156, PT0650, PT0695, PT0723, PT0838, PT0879, and PT0740.

vii. Photosynthetic Tissue Promoters

Promoters active in photosynthetic tissue confer transcription in green tissues such as leaves and stems. Most suitable are promoters that drive expression only or predominantly in such tissues. Examples of such promoters include the ribulose-1,5-bisphosphate carboxylase (RbcS) promoters such as the RbcS promoter from eastern larch (*Larix laricina*), the pine cab6 promoter (Yamamoto et al., *Plant Cell Physiol.*, 35:773-778 (1994)), the Cab-1 promoter from wheat (Fejes et al., *Plant Mol. Biol.*, 15:921-932 (1990)), the CAB-1 promoter from spinach (Lubberstedt et al., *Plant Physiol.*, 104:997-1006 (1994)), the cab1R promoter from rice (Luan et al., *Plant Cell*, 4:971-981 (1992)), the pyruvate orthophosphate dikinase (PPDK) promoter from corn (Matsuoka et al., *Proc. Natl. Acad. Sci. USA*, 90:9586-9590 (1993)), the tobacco Lhcb1*2 promoter (Cerdan et al., *Plant Mol. Biol.*, 33:245-255 (1997)), the *Arabidopsis thaliana* SUC2 sucrose-H+ symporter promoter (Truernit et al., *Planta*, 196:564-570 (1995)), and thylakoid membrane protein promoters from spinach (psaD, psaF, psaE, PC, FNR, atpC, atpD, cab, rbcS). Other photosynthetic tissue promoters include PT0535, PT0668, PT0886, YP0144, YP0380 and PT0585.

viii. Vascular Tissue Promoters

Examples of promoters that have high or preferential activity in vascular bundles include YP0087, YP0093, YP0108, YP0022, and YP0080. Other vascular tissue-preferential promoters include the glycine-rich cell wall protein GRP 1.8 promoter (Keller and Baumgartner, *Plant Cell*, 3(10):1051-1061 (1991)), the Commelina yellow mottle virus (CoYMV) promoter (Medberry et al., *Plant Cell*, 4(2):185-192 (1992)), and the rice tungro bacilliform virus (RTBV) promoter (Dai et al., *Proc. Natl. Acad. Sci. USA*, 101(2):687-692 (2004)).

ix. Inducible Promoters

Inducible promoters confer transcription in response to external stimuli such as chemical agents or environmental stimuli. For example, inducible promoters can confer transcription in response to hormones such as giberellic acid or ethylene, or in response to light or drought. Examples of drought-inducible promoters include YP0380, PT0848, YP0381, YP0337, PT0633, YP0374, PT0710, YP0356, YP0385, YP0396, YP0388, YP0384, PT0688, YP0286, YP0377, PD1367, and PD0901. Examples of nitrogen-inducible promoters include PT0863, PT0829, PT0665, and PT0886. Examples of shade-inducible promoters include PR0924 and PT0678. An example of a promoter induced by salt is rd29A (Kasuga et al., *Nature Biotech* 17: 287-291 (1999)).

x. Basal Promoters

A basal promoter is the minimal sequence necessary for assembly of a transcription complex required for transcription initiation. Basal promoters frequently include a "TATA box" element that may be located between about 15 and about 35 nucleotides upstream from the site of transcription initiation. Basal promoters also may include a "CCAAT box" element (typically the sequence CCAAT) and/or a GGGCG sequence, which can be located between about 40 and about 200 nucleotides, typically about 60 to about 120 nucleotides, upstream from the transcription start site.

xi. Stem Promoters

A stem promoter may be specific to one or more stem tissues or specific to stem and other plant parts. Stem promoters may have high or preferential activity in, for example, epidermis and cortex, vascular cambium, procambium, or xylem. Examples of stem promoters include YP0018 which is disclosed in US20060015970 and CryIA (b) and CryIA(c) (Braga et al., *Journal of New Seeds* 5:209-221 (2003)).

xii. Other Promoters

Other classes of promoters include, but are not limited to, shoot-preferential, callus-preferential, trichome cell-preferential, guard cell-preferential such as PT0678, tuber-preferential, parenchyma cell-preferential, and senescence-preferential promoters. Promoters designated YP0086, YP0188, YP0263, PT0758, PT0743, PT0829, YP0119, and YP0096, as described in the above-referenced patent applications, may also be useful.

xiii. Other Regulatory Regions

A 5' untranslated region (UTR) can be included in nucleic acid constructs described herein. A 5' UTR is transcribed, but is not translated, and lies between the start site of the transcript and the translation initiation codon and may include the +1 nucleotide. A 3' UTR can be positioned between the translation termination codon and the end of the transcript. UTRs can have particular functions such as increasing mRNA stability or attenuating translation. Examples of 3' UTRs include, but are not limited to, polyadenylation signals and transcription termination sequences, e.g., a nopaline synthase termination sequence.

It will be understood that more than one regulatory region may be present in a recombinant polynucleotide, e.g., introns, enhancers, upstream activation regions, transcription terminators, and inducible elements. Thus, for example, more than one regulatory region can be operably linked to the sequence of a polynucleotide encoding a heat and/or drought-tolerance polypeptide.

Regulatory regions, such as promoters for endogenous genes, can be obtained by chemical synthesis or by subcloning from a genomic DNA that includes such a regulatory region. A nucleic acid comprising such a regulatory region can also include flanking sequences that contain restriction enzyme sites that facilitate subsequent manipulation.

IV. TRANSGENIC PLANTS AND PLANT CELLS

A. Transformation

The invention also features transgenic plant cells and plants comprising at least one recombinant nucleic acid construct described herein. A plant or plant cell can be transformed by having a construct integrated into its genome, i.e., can be stably transformed. Stably transformed cells typically retain the introduced nucleic acid with each cell division. A plant or plant cell can also be transiently transformed such that the construct is not integrated into its genome. Transiently transformed cells typically lose all or some portion of the introduced nucleic acid construct with each cell division such that the introduced nucleic acid cannot be detected in daughter cells after a sufficient number of cell divisions. Both transiently transformed and stably transformed transgenic plants and plant cells can be useful in the methods described herein.

Transgenic plant cells used in methods described herein can constitute part or all of a whole plant. Such plants can be grown in a manner suitable for the species under consideration, either in a growth chamber, a greenhouse, or in a field. Transgenic plants can be bred as desired for a particular purpose, e.g., to introduce a recombinant nucleic acid into other lines, to transfer a recombinant nucleic acid to other species, or for further selection of other desirable traits. Alternatively, transgenic plants can be propagated vegetatively for those species amenable to such techniques. As used herein, a transgenic plant also refers to progeny of an initial transgenic plant provided the progeny inherits the transgene. Seeds produced by a transgenic plant can be grown and then selfed (or outcrossed and selfed) to obtain seeds homozygous for the nucleic acid construct.

Transgenic plants can be grown in suspension culture, or tissue or organ culture. For the purposes of this invention, solid and/or liquid tissue culture techniques can be used. When using solid medium, transgenic plant cells can be placed directly onto the medium or can be placed onto a filter that is then placed in contact with the medium. When using liquid medium, transgenic plant cells can be placed onto a flotation device, e.g., a porous membrane that contacts the liquid medium. A solid medium can be, for example, Murashige and Skoog (MS) medium containing agar and a suitable concentration of an auxin, e.g., 2,4-dichlorophenoxyacetic acid (2,4-D), and a suitable concentration of a cytokinin, e.g., kinetin.

When transiently transformed plant cells are used, a reporter sequence encoding a reporter polypeptide having a reporter activity can be included in the transformation procedure and an assay for reporter activity or expression can be performed at a suitable time after transformation. A suitable time for conducting the assay typically is about 1-21 days after transformation, e.g., about 1-14 days, about 1-7 days, or about 1-3 days. The use of transient assays is particularly convenient for rapid analysis in different species, or to confirm expression of a heterologous heat and/or drought-tolerance polypeptide whose expression has not previously been confirmed in particular recipient cells.

Techniques for introducing nucleic acids into monocotyledonous and dicotyledonous plants are known in the art, and include, without limitation, *Agrobacterium*-mediated transformation, viral vector-mediated transformation, electroporation and particle gun transformation, e.g., U.S. Pat. Nos. 5,538,880; 5,204,253; 6,329,571 and 6,013,863. If a cell or cultured tissue is used as the recipient tissue for transformation, plants can be regenerated from transformed cultures if desired, by techniques known to those skilled in the art.

B. Screening/Selection

A population of transgenic plants can be screened and/or selected for those members of the population that have a trait or phenotype conferred by expression of the transgene. For example, a population of progeny of a single transformation event can be screened for those plants having a desired level of expression of a heat and/or drought-tolerance polypeptide or nucleic acid. Physical and biochemical methods can be used to identify expression levels. These include Southern analysis or PCR amplification for detection of a polynucleotide; Northern blots, S1 RNase protection, primer-extension, or RT-PCR amplification for detecting RNA transcripts; enzymatic assays for detecting enzyme or ribozyme activity of polypeptides and polynucleotides; and protein gel electrophoresis, Western blots, immunoprecipitation, and enzyme-linked immunoassays to detect polypeptides. Other techniques such as in situ hybridization, enzyme staining, and immunostaining also can be used to detect the presence or expression of polypeptides and/or polynucleotides. Methods for performing all of the referenced techniques are known. As an alternative, a population of plants comprising independent transformation events can be screened for those plants having a desired trait, such as increased drought tolerance or increased heat tolerance. Selection and/or screening can be carried out over one or more generations, and/or in more than one geographic location. In some cases, transgenic plants can be grown and selected under conditions which induce a desired phenotype or are otherwise necessary to produce a desired phenotype in a transgenic plant. In addition, selection and/or screening can be applied during a particular developmental stage in which the phenotype is expected to be exhibited by the plant. Selection and/or screening can be carried out to choose those transgenic plants having a statistically significant difference in heat and/or drought tolerance relative to a control plant that lacks the transgene. Selected or screened transgenic plants have an altered phenotype as compared to a corresponding control plant, as described in the "Transgenic Plant Phenotypes" section herein.

C. Plant Species

The polynucleotides and vectors described herein can be used to transform a number of monocotyledonous and dicotyledonous plants and plant cell systems, including species from one of the following families: Acanthaceae, Alliaceae, Alstroemeriaceae, Amaryllidaceae, Apocynaceae, Arecaceae, Asteraceae, Berberidaceae, Bixaceae, Brassicaceae, Bromeliaceae, Cannabaceae, Caryophyllaceae, Cephalotaxaceae, Chenopodiaceae, Colchicaceae, Cucurbitaceae, Dioscoreaceae, Ephedraceae, Erythroxylaceae, Euphorbiaceae, Fabaceae, Lamiaceae, Linaceae, Lycopodiaceae, Malvaceae, Melanthiaceae, Musaceae, Myrtaceae, Nyssaceae, Papaveraceae, Pinaceae, Plantaginaceae, Poaceae, Rosaceae, Rubiaceae, Salicaceae, Sapindaceae, Solanaceae, Taxaceae, Theaceae, or Vitaceae.

Suitable species may include members of the genus *Abelmoschus, Abies, Acer, Agrostis, Allium, Alstroemeria, Ananas, Andrographis, Andropogon, Artemisia, Arundo, Atropa, Berberis, Beta, Bixa, Brassica, Calendula, Camellia, Camptotheca, Cannabis, Capsicum, Carthamus, Catharanthus, Cephalotaxus, Chrysanthemum, Cinchona, Citrullus, Coffea, Colchicum, Coleus, Cucumis, Cucurbita, Cynodon, Datura, Dianthus, Digitalis, Dioscorea, Elaeis, Ephedra, Erianthus, Erythroxylum, Eucalyptus, Festuca, Fragaria, Galanthus, Glycine, Gossypium, Helianthus, Hevea, Hordeum, Hyoscyamus, Jatropha, Lactuca, Linum, Lolium, Lupinus, Lycopersicon, Lycopodium, Manihot, Medicago, Mentha, Miscanthus, Musa, Nicotiana, Oryza, Panicum, Papaver, Parthenium, Pennisetum, Petunia, Phalaris, Phleum, Pinus, Poa, Poinsettia, Populus, Rauwolfia, Ricinus, Rosa, Saccharum, Salix, Sanguinaria, Scopolia, Secale, Solanum, Sorghum, Spartina, Spinacea, Tanacetum, Taxus, Theobroma, Triticosecale, Triticum, Uniola, Veratrum, Vinca, Vitis,* and *Zea.*

Suitable species include *Panicum* spp. or hybrids thereof, *Sorghum* spp. or hybrids thereof, sudangrass, *Miscanthus* spp. or hybrids thereof, *Saccharum* spp. or hybrids thereof, *Erianthus* spp., *Populus* spp., *Andropogon gerardii* (big bluestem), *Pennisetum purpureum* (elephant grass) or hybrids thereof (e.g., *Pennisetum purpureum* x *Pennisetum typhoidum*), *Phalaris arundinacea* (reed canarygrass), *Cynodon dactylon* (bermudagrass), *Festuca arundinacea* (tall fescue), *Spartina pectinata* (prairie cord-grass), *Medicago sativa* (alfalfa), *Arundo donax* (giant reed) or hybrids thereof, *Secale cereale* (rye), *Salix* spp. (willow), *Eucalyptus* spp. (eucalyptus), *Triticosecale* (*Triticum*—wheat X rye), *Tripsicum dactyloides* (Eastern gammagrass), *Leymus cinereus* (basin wildrye), *Leymus condensatus* (giant wildrye), and bamboo.

In some embodiments, a suitable species can be a wild, weedy, or cultivated sorghum species such as, but not limited to, *Sorghum almum, Sorghum amplum, Sorghum angustum, Sorghum arundinaceum, Sorghum bicolor* (such as bicolor, guinea, caudatum, kafir, and durra), *Sorghum brachypodum, Sorghum bulbosum, Sorghum burmahicum, Sorghum controversum, Sorghum drummondii, Sorghum ecarinatum, Sorghum exstans, Sorghum grande, Sorghum halepense, Sorghum interjectum, Sorghum intrans, Sorghum laxiflorum, Sorghum leiocladum, Sorghum macrospermum, Sorghum matarankense, Sorghum miliaceum, Sorghum nigrum, Sorghum nitidum, Sorghum plumosum, Sorghum propinquum, Sorghum purpureosericeum, Sorghum stipoi-*

*deum, Sorghum sudanensese, Sorghum timorense, Sorghum trichocladum, Sorghum versicolor, Sorghum virgatum, Sorghum vulgare*, or hybrids such as *Sorghum* x *almum, Sorghum* x *sudangrass* or *Sorghum* x *drummondii*.

Suitable species also include *Helianthus annuus* (sunflower), *Carthamus tinctorius* (safflower), *Jatropha curcas* (jatropha), *Ricinus communis* (castor), *Elaeis guineensis* (palm), *Linum usitatissimum* (flax), and *Brassica juncea*.

Suitable species also include *Beta vulgaris* (sugarbeet), and *Manihot esculenta* (cassava).

Suitable species also include *Lycopersicon esculentum* (tomato), *Lactuca sativa* (lettuce), *Musa paradisiaca* (banana), *Solanum tuberosum* (potato), *Brassica oleracea* (broccoli, cauliflower, brusselsprouts), *Camellia sinensis* (tea), *Fragaria ananassa* (strawberry), *Theobroma cacao* (cocoa), *Coffea arabica* (coffee), *Vitis vinifera* (grape), *Ananas comosus* (pineapple), *Capsicum annum* (hot & sweet pepper), *Allium cepa* (onion), *Cucumis melo* (melon), *Cucumis sativus* (cucumber), *Cucurbita maxima* (squash), *Cucurbita moschata* (squash), *Spinacea oleracea* (spinach), *Citrullus lanatus* (watermelon), *Abelmoschus esculentus* (okra), and *Solanum melongena* (eggplant).

Suitable species also include *Papaver somniferum* (opium poppy), *Papaver orientale, Taxus baccata, Taxus brevifolia, Artemisia annua, Cannabis sativa, Camptotheca acuminate, Catharanthus roseus, Vinca rosea, Cinchona officinalis, Colchicum autumnale, Veratrum californica, Digitalis lanata, Digitalis purpurea, Dioscorea spp., Andrographis paniculata, Atropa belladonna, Datura stomonium, Berberis* spp., *Cephalotaxus* spp., *Ephedra sinica, Ephedra* spp *Erythroxylum coca, Galanthus wornorii, Scopolia* spp., *Lycopodium serratum* (=*Huperzia serrata*), *Lycopodium* spp *Rauwolfia serpentina, Rauwolfia* spp., *Sanguinaria canadensis, Hyoscyamus* spp., *Calendula officinalis, Chrysanthemum parthenium, Coleus forskohlii*, and *Tanacetum parthenium*.

Suitable species also include *Parthenium argentatum* (guayule), *Hevea* spp. (rubber), *Mentha spicata* (mint), *Mentha piperita* (mint), *Bixa orellana*, and *Alstroemeria* spp.

Suitable species also include *Rosa* spp. (rose), *Dianthus caryophyllus* (carnation), *Petunia* spp. (petunia) and *Poinsettia pulcherrima* (poinsettia).

Suitable species also include *Nicotiana tabacum* (tobacco), *Lupinus albus* (lupin), *Uniola paniculata* (oats), bentgrass (*Agrostis* spp.), *Populus tremuloides* (aspen), *Pinus* spp. (pine), *Abies* spp. (fir), *Acer* spp. (maple, *Hordeum vulgare* (barley), *Poa pratensis* (bluegrass), *Lolium* spp. (ryegrass) and *Phleum pratense* (timothy).

Thus, the methods and compositions can be used over a broad range of plant species, including species from the dicot genera *Brassica, Carthamus, Glycine, Gossypium, Helianthus, Jatropha, Parthenium, Populus*, and *Ricinus*; and the monocot genera *Elaeis, Festuca, Hordeum, Lolium, Oryza, Panicum, Pennisetum, Phleum, Poa, Saccharum, Secale, Sorghum, Triticosecale, Triticum*, and *Zea*. In some embodiments, a plant is a member of the species *Panicum virgatum* (switchgrass), *Sorghum bicolor* (sorghum, sudangrass), *Miscanthus giganteus* (miscanthus), *Saccharum* sp. (energycane), *Populus balsamifera* (poplar), *Zea mays* (corn), *Glycine max* (soybean), *Brassica napus* (canola), *Triticum aestivum* (wheat), *Gossypium hirsutum* (cotton), *Oryza sativa* (rice), *Helianthus annuus* (sunflower), *Medicago sativa* (alfalfa), *Beta vulgaris* (sugarbeet), or *Pennisetum glaucum* (pearl millet).

In certain embodiments, the polynucleotides and vectors described herein can be used to transform a number of monocotyledonous and dicotyledonous plants and plant cell systems, wherein such plants are hybrids of different species or varieties of a specific species (e.g., *Saccharum* sp. x *Miscanthus* sp., *Saccharum* sp. x *Sorghum* sp., *Panicum virgatum* x *Panicum amarum, Panicum virgatum* x *Panicum amarulum*, and *Pennisetum purpureum* x *Pennisetum typhoidum*).

D. Transgenic Plant Phenotypes

In some embodiments, a plant in which expression of a heat and/or drought-tolerance polypeptide is modulated can have increased heat tolerance or drought tolerance. In some cases, a plant in which expression of a heat and/or drought-tolerance polypeptide is modulated can exhibit both heat tolerance and drought tolerance. The phenotype of a transgenic plant in which expression of a heat and/or drought-tolerance polypeptide is modulated and a corresponding control plant that either lacks the transgene or does not express the transgene can be evaluated under particular environmental conditions that are useful for simulating drought conditions. The phenotype of a transgenic plant in which expression of a heat and/or drought-tolerance polypeptide is modulated and a corresponding control plant can also be evaluated under heat shock conditions.

For example, a heat and/or drought-tolerance polypeptide described herein can be expressed in a transgenic plant, resulting in increased growth as compared to a plant that does not express the polypeptide when grown under drought conditions or heat shock conditions, or following such conditions. Growth can be assessed with physiological parameters such as, for example, plant height, number of new shoots, number of new leaves, leaf length, seedling area, or seed number.

In some cases, a transgenic plant expressing a heat and/or drought tolerance polypeptide described herein can exhibit a height that is from about 5% to about 100% greater (e.g., about 5% to about 12%; about 5% to about 40%; about 5% to about 80%; about 7% to about 20%; about 10% to about 15%; about 10% to about 50%; about 10% to about 90%; about 20% to about 25%; about 20% to about 45%; about 20% to about 75%; about 25% to about 60%; about 25% to about 100%; about 30% to about 50%; about 30% to about 70%; about 40% to about 50%; about 45% to about 60%; about 50% to about 80%; about 55% to about 75%; about 60% to about 80%; about 60% to about 95%; about 75% to about 100%; about 80% to about 100%; about 90% to about 95%; or about 95% to about 100% greater) than a plant not expressing the polypeptide when grown under drought conditions or heat shock conditions, or following such conditions.

In some instances, a transgenic plant expressing a heat and/or drought-tolerance polypeptide can exhibit greater leaf area or greater leaf length than a corresponding control plant that does not express the polypeptide when grown under heat shock conditions or drought conditions, or following such conditions. For example, a transgenic plant expressing a heat and/or drought-tolerance polypeptide can have a leaf area that is 5% to about 100% greater (e.g., about 5% to about 7%; about 5% to about 20%; about 8% to about 80%; about 10% to about 20%; about 10% to about 25%; about 10% to about 50%; about 10% to about 90%; about 15% to about 25%; about 20% to about 45%; about 20% to about 70%; about 25% to about 40%; about 25% to about 100%; about 30% to about 50%; about 30% to about 70%; about 40% to about 50%; about 45% to about 60%; about 50% to about 80%; about 55% to about 75%; about 60% to about 80%; about 60% to about 95%; about 75% to about 100%; about 80% to about 100%; about 90% to about 95%;

or about 95% to about 100% greater) than a corresponding control plant that does not express the polypeptide when grown under heat shock conditions or drought conditions, or following such conditions. In another example, a transgenic plant expressing a heat and/or drought-tolerance polypeptide can have a leaf length that is from about 5% to about 100% greater (e.g., about 5% to about 12%; about 5% to about 40%; about 5% to about 80%; about 7% to about 20%; about 10% to about 15%; about 10% to about 50%; about 10% to about 90%; about 20% to about 25%; about 20% to about 45%; about 20% to about 75%; about 25% to about 60%; about 25% to about 100%; about 30% to about 50%; about 30% to about 70%; about 40% to about 50%; about 45% to about 60%; about 50% to about 80%; about 55% to about 75%; about 60% to about 80%; about 60% to about 95%; about 75% to about 100%; about 80% to about 100%; about 90% to about 95%; or about 95% to about 100% greater) than a corresponding control plant that does not express the polypeptide when grown under heat shock conditions or drought conditions, or following such conditions.

In other cases, when a polypeptide described herein is expressed in a transgenic plant, the transgenic plant can exhibit a seed number (number of seeds per plant) from about 10% to about 95% greater (e.g., from about 10% to about 20%; from about 10% to about 50%; from about 10% to about 70%; from about 20% to about 60%; from about 20% to about 75%; from about 25% to about 85%; from about 30% to about 70%; from about 35% to about 90%; from about 40% to about 60%; from about 40% to about 85%; from about 50% to about 80%; from about 50% to about 90%; or from about 70% to about 90% greater) than a control plant not expressing the polypeptide when grown under heat shock conditions or drought conditions. In certain cases, when a polypeptide described herein is expressed in a transgenic plant, the transgenic plant can exhibit an increase in seed weight per plant from about 5% to about 100% greater (e.g., about 5% to about 12%; about 5% to about 40%; about 5% to about 80%; about 7% to about 20%; about 10% to about 15%; about 10% to about 50%; about 10% to about 90%; about 20% to about 25%; about 20% to about 45%; about 20% to about 75%; about 25% to about 60%; about 25% to about 100%; about 30% to about 50%; about 30% to about 70%; about 40% to about 50%; about 45% to about 60%; about 50% to about 80%; about 55% to about 75%; about 60% to about 80%; about 60% to about 95%; about 75% to about 100%; about 80% to about 100%; about 90% to about 95%; or about 95% to about 100% greater) than the seed weight in a plant not expressing the polypeptide when grown under heat shock conditions or drought conditions.

Transgenic plants expressing a heat and/or drought-tolerance polypeptide also can exhibit a lower transpiration rate compared to control plants of the same genetic background. Transpiration rate is another physiological parameter that is indicative of how well a plant can tolerate drought conditions. For example, plants with a low transpiration rate are expected to lose water more slowly than plants with higher transpiration rates and therefore would be expected to better withstand drought conditions (i.e., have better drought tolerance). When a polypeptide described herein is expressed in a transgenic plant, the transgenic plant can exhibit a transpiration rate that is reduced by about 0.25% to 100% (e.g., 0.27%, 0.3%, 0.43%, 0.55%, 0.7%, 0.99%, 1%, 2%, 4%, 6%, 8%, 10%, 12%, 15%, 18%, 22%, 28%, 35%, 37%, 42%, 45%, 47%, 50%, 55%, 64%, 68%, 71%, 75%, 77%, 80%, 83%, 86%, 89%, 90%, 92%, 95%, 98%, or 99%) as compared to the transpiration rate in a corresponding control plant when grown under drought conditions.

In some cases, a transgenic plant expressing a heat and/or drought-tolerance polypeptide described herein can exhibit a decreased change in photosynthetic activity ($\Delta Fv/Fm$) after exposure to heat shock conditions as compared to a corresponding control plant that does not express the polypeptide when grown under the same conditions. In some cases, a transgenic plant expressing a heat and/or drought-tolerance polypeptide described herein can exhibit an increased change in photosynthetic activity ($\Delta Fv/Fm-D_2$) two days post heat-shock treatment as compared to a corresponding control plant that does not express the polypeptide when grown under the same conditions. For example, a transgenic plant expressing a heat and/or drought-tolerance polypeptide can exhibit a $\Delta Fv/Fm$ of from about 0.1 to about 0.8 (e.g., about 0.2 to about 0.28; about 0.2 to about 0.32; about 0.22 to about 0.35; about 0.29 to about 0.4; about 0.3 to about 0.45; about 0.33 to about 0.41; about 0.35 to about 0.5; about 0.4 to about 0.8; about 0.46 to about 0.52; about 0.5 to about 0.65; about 0.5 to about 0.8; about 0.6 to about 0.7; about 0.6 to about 0.9; about 0.65 to about 0.75; about 0.7 to about 0.9; or about 0.75 to about 0.8) or a $\Delta Fv/Fm-D_2$ range of from about 0.03 to about 0.8 (e.g., about 0.03 to about 0.08; about 0.03 to about 0.032; about 0.04 to about 0.05; about 0.09 to about 0.4; about 0.05 to about 0.5; about 0.075 to about 0.1; about 0.08 to about 0.2; about 0.3 to about 0.45; about 0.33 to about 0.41; about 0.35 to about 0.5; about 0.4 to about 0.8; about 0.46 to about 0.52; about 0.5 to about 0.65; about 0.5 to about 0.8; about 0.6 to about 0.7; about 0.6 to about 0.9; about 0.65 to about 0.75; about 0.7 to about 0.9; about 0.75 to about 0.85; or about 0.8 to about 0.9). In some embodiments, photosynthetic activity can be reduced by about 0.25% to about 100% (e.g., about 0.25% to about 0.4%, about 0.25% to about 1%, about 0.25% to about 5%, about 0.5% to about 10%, about 1% to about 5%, about 1% to about 10%, about 2% to about 8%, about 3% to about 20%, about 5% to about 7%; about 5% to about 20%; about 5% to about 45%, about 8% to about 80%; about 10% to about 20%; about 10% to about 25%; about 10% to about 50%; about 10% to about 90%; about 15% to about 25%; about 20% to about 45%; about 20% to about 70%; about 25% to about 40%; about 25% to about 99%; about 30% to about 50%; about 30% to about 70%; about 40% to about 50%; about 45% to about 60%; about 50% to about 80%; about 55% to about 75%; about 60% to about 80%; about 60% to about 95%; about 75% to about 99%; about 80% to about 99%; about 90% to about 95%; or about 95% to about 100%) as compared to the photosynthetic activity in a corresponding control plant following heat shock conditions.

Typically, a difference in the heat and/or drought tolerance in a transgenic plant relative to a control plant is considered statistically significant at $p \leq 0.05$ with an appropriate parametric or non-parametric statistic, e.g., Chi-square test, Student's t-test, Mann-Whitney test, or F-test. In some embodiments, a difference in the heat and/or drought tolerance is statistically significant at $p<0.1$, $p<0.05$, or $p<0.01$.

The phenotype of a transgenic plant is evaluated relative to a control plant. A plant is said "not to express" a polypeptide when the plant exhibits less than 10%, e.g., less than 9%, 8%, 7%, 6%, 5%, 4%, 3%, 2%, 1%, 0.5%, 0.1%, 0.1%, or 0.01%, of the amount of polypeptide or mRNA encoding the polypeptide exhibited by the plant of interest. Expression can be evaluated using methods including, for example, RT-PCR, Northern blots, S1 RNase protection, primer extensions, Western blots, protein gel electrophoresis, immunoprecipitation, enzyme-linked immunoassays, chip assays, and mass spectrometry. It should be noted that if a polypeptide is expressed under the control of a tissue-preferential or broadly expressing promoter, expression can be evaluated in the entire plant or in a selected tissue. Similarly, if a polypeptide is expressed at a particular time, e.g., at a particular time in development or upon induction, expression can be evaluated selectively at a desired time period.

V. PLANT BREEDING

Genetic polymorphisms are discrete allelic sequence differences in a population. Typically, an allele that is present at 1% or greater is considered to be a genetic polymorphism. The discovery that polypeptides disclosed herein can increase heat and/or drought tolerance is useful in plant breeding, because genetic polymorphisms exhibiting a degree of linkage with loci for such polypeptides are more likely to be correlated with variation in heat and/or drought tolerance. For example, genetic polymorphisms linked to the loci for such polypeptides are more likely to be useful in marker-assisted breeding programs to create lines having increased heat and/or drought tolerance.

Thus, one aspect of the invention includes methods of identifying whether one or more genetic polymorphisms are associated with heat and/or drought tolerance. Such methods involve determining whether genetic polymorphisms in a given population exhibit linkage with the locus for one of the polypeptides depicted in FIGS. 1-16 and/or a functional homolog thereof. The correlation is measured between variation in heat and/or drought tolerance in plants of the population and the presence of the genetic polymorphism(s) in plants of the population, thereby identifying whether or not the genetic polymorphism(s) are associated with variation for the trait. If the presence of a particular allele is statistically significantly correlated with a modulation in heat and/or drought tolerance, the allele is associated with variation for the trait and is useful as a marker for the trait. If, on the other hand, the presence of a particular allele is not significantly correlated with the desired modulation, the allele is not associated with variation for the trait and is not useful as a marker.

Such methods are applicable to populations containing the naturally occurring endogenous polypeptide rather than an exogenous nucleic acid encoding the polypeptide, i.e., populations that are not transgenic for the exogenous nucleic acid. It will be appreciated, however, that populations suitable for use in the methods may contain a transgene for another, different trait, e.g., herbicide resistance.

Genetic polymorphisms that are useful in such methods include simple sequence repeats (SSRs, or microsatellites), rapid amplification of polymorphic DNA (RAPDs), single nucleotide polymorphisms (SNPs), amplified fragment length polymorphisms (AFLPs) and restriction fragment length polymorphisms (RFLPs). SSR polymorphisms can be identified, for example, by making sequence specific probes and amplifying template DNA from individuals in the population of interest by PCR. For example, PCR techniques can be used to enzymatically amplify a genetic marker associated with a nucleotide sequence conferring a specific trait (e.g., nucleotide sequences described herein). PCR can be used to amplify specific sequences from DNA as well as RNA, including sequences from total genomic DNA or total cellular RNA. When using RNA as a source of template, reverse transcriptase can be used to synthesize complementary DNA (cDNA) strands. Various PCR methods are described, for example, in *PCR Primer: A Laboratory Manual*, Dieffenbach and Dveksler, eds., Cold Spring Harbor Laboratory Press, 1995.

Generally, sequence information from polynucleotides flanking the region of interest or beyond is employed to design oligonucleotide primers that are identical or similar in sequence to opposite strands of the template to be amplified. Primers are typically 14 to 40 nucleotides in length, but can range from 10 nucleotides to hundreds of nucleotides in length. Template and amplified DNA is repeatedly denatured at a high temperature to separate the double strand, then cooled to allow annealing of primers and the extension of nucleotide sequences through the microsatellite, resulting in sufficient DNA for detection of PCR products. If the probes flank an SSR in the population, PCR products of different sizes will be produced. See, e.g., U.S. Pat. No. 5,766,847.

PCR products can be qualitative or quantitatively analyzed using several techniques. For example, PCR products can be stained with a fluorescent molecule (e.g., PicoGreen® or OliGreen®) and detected in solution using spectrophotometry or capillary electrophoresis. In some cases, PCR products can be separated in a gel matrix (e.g., agarose or polyacrylamide) by electrophoresis, and size-fractionated bands comprising PCR products can be visualized using nucleic acid stains. Suitable stains can fluoresce under UV light (e.g., Ethidium bromide, GR Safe, SYBR® Green, or SYBR® Gold). The results can be visualized via transillumination or epi-illumination, and an image of the fluorescent pattern can be acquired using a camera or scanner, for example. The image can be processed and analyzed using specialized software (e.g., ImageJ) to measure and compare the intensity of a band of interest against a standard loaded on the same gel.

Alternatively, SSR polymorphisms can be identified by using PCR product(s) as a probe against Southern blots from different individuals in the population. See, U. H. Refseth et al., (1997) *Electrophoresis* 18: 1519. Briefly, PCR products are separated by length through gel electrophoresis and transferred to a membrane. SSR-specific DNA probes, such as oligonucleotides labeled with radioactive, fluorescent, or chromogenic molecules, are applied to the membrane and hybridize to bound PCR products with a complementary nucleotide sequence. The pattern of hybridization can be visualized by autoradiography or by development of color on the membrane, for example.

In some cases, PCR products can be quantified using a real-time thermocycler detection system. For example, Quantitative real-time PCR can use a fluorescent dye that forms a DNA-dye-complex (e.g., SYBR® Green), or a fluorophore-containing DNA probe, such as single-stranded oligonucleotides covalently bound to a fluorescent reporter or fluorophore (e.g. 6-carboxyfluorescein or tetrachlorofluorescin) and quencher (e.g., tetramethylrhodamine or dihydrocyclopyrroloindole tripeptide minor groove binder). The fluorescent signal allows detection of the amplified product in real time, thereby indicating the presence of a sequence of interest, and allowing quantification of the copy number of a sequence of interest in cellular DNA or expression level of a sequence of interest from cellular mRNA.

The identification of RFLPs is discussed, for example, in Alonso-Blanco et al. (*Methods in Molecular Biology*, vol. 82, "*Arabidopsis* Protocols", pp. 137-146, J. M. Martinez-Zapater and J. Salinas, eds., c. 1998 by Humana Press, Totowa, N.J.); Burr ("Mapping Genes with Recombinant Inbreds", pp. 249-254, in Freeling, M. and V. Walbot (Ed.), *The Maize Handbook*, c. 1994 by Springer-Verlag New York, Inc.: New York, N.Y., USA; Berlin Germany; Burr et al. *Genetics* (1998) 118: 519; and Gardiner, J. et al., (1993) *Genetics* 134: 917). For example, to produce a RFLP library enriched with single- or low-copy expressed sequences, total DNA can be digested with a methylation-sensitive enzyme (e.g., PstI). The digested DNA can be separated by size on a preparative gel. Polynucleotide fragments (500 to 2000 bp) can be excised, eluted and cloned into a plasmid vector (e.g., pUC18). Southern blots of plasmid digests can be probed with total sheared DNA to select clones that hybridize to single- and low-copy sequences. Additional restriction endonucleases can be tested to increase the number of polymorphisms detected.

The identification of AFLPs is discussed, for example, in EP 0 534 858 and U.S. Pat. No. 5,878,215. In general, total cellular DNA is digested with one or more restriction enzymes. Restriction halfsite-specific adapters are ligated to all restriction fragments and the fragments are selectively amplified with two PCR primers that have corresponding adaptor and restriction site specific sequences. The PCR products can be visualized after size-fractionation, as described above.

In some embodiments, the methods are directed to breeding a plant line. Such methods use genetic polymorphisms identified as described above in a marker assisted breeding program to facilitate the development of lines that have increased heat and/or drought tolerance. Once a suitable genetic polymorphism is identified as being associated with variation for the trait, one or more individual plants are identified that possess the polymorphic allele correlated with the desired variation. Those plants are then used in a breeding program to combine the polymorphic allele with a plurality of other alleles at other loci that are correlated with the desired variation. Techniques suitable for use in a plant breeding program are known in the art and include, without limitation, backcrossing, mass selection, pedigree breeding, bulk selection, crossing to another population and recurrent selection. These techniques can be used alone or in combination with one or more other techniques in a breeding program. Thus, each identified plants is selfed or crossed a different plant to produce seed which is then germinated to form progeny plants. At least one such progeny plant is then selfed or crossed with a different plant to form a subsequent progeny generation. The breeding program can repeat the steps of selfing or outcrossing for an additional 0 to 5 generations as appropriate in order to achieve the desired uniformity and stability in the resulting plant line, which retains the polymorphic allele. In most breeding programs, analysis for the particular polymorphic allele will be carried out in each generation, although analysis can be carried out in alternate generations if desired.

In some cases, selection for other useful traits is also carried out, e.g., selection for fungal resistance or bacterial resistance. Selection for such other traits can be carried out before, during or after identification of individual plants that possess the desired polymorphic allele.

VI. ARTICLES OF MANUFACTURE

Transgenic plants provided herein have various uses in the agricultural and energy production industries. For example, transgenic plants described herein can be used to make animal feed and food products. Such plants, however, are often particularly useful as a feedstock for energy production.

Transgenic plants described herein often produce higher yields of grain and/or biomass per hectare, relative to control plants that lack the exogenous nucleic acid. In some embodiments, such transgenic plants provide equivalent or even increased yields of grain and/or biomass per hectare relative to control plants when grown under conditions of reduced inputs such as fertilizer and/or water. Thus, such transgenic plants can be used to provide yield stability at a lower input cost and/or under environmentally stressful conditions such as drought. In some embodiments, plants described herein have a composition that permits more efficient processing into free sugars, and subsequently ethanol, for energy production. In some embodiments, such plants provide higher yields of ethanol, other biofuel molecules, and/or sugar-derived co-products per kilogram of plant material, relative to control plants. By providing higher yields higher yields under environmentally stressful conditions such as drought conditions and/or heat shock conditions, the transgenic plants described herein improve profitability for farmers and processors as well as decrease costs to consumers.

Seeds from transgenic plants described herein can be conditioned and bagged in packaging material by means known in the art to form an article of manufacture. Packaging material such as paper and cloth are well known in the art. A package of seed can have a label, e.g., a tag or label secured to the packaging material, a label printed on the packaging material, or a label inserted within the package, that describes the nature of the seeds therein.

The invention will be further described in the following examples, which do not limit the scope of the invention described in the claims.

VII. EXAMPLES

Example 1—Transgenic *Arabidopsis* Plants

The following symbols are used in the Examples with respect to *Arabidopsis* transformation: $T_1$: first generation transformant; $T_2$: second generation, progeny of self-pollinated $T_1$ plants; $T_3$: third generation, progeny of self-pollinated $T_2$ plants; $T_4$: fourth generation, progeny of self-pollinated $T_3$ plants. Independent transformations are referred to as events.

Nucleic acids were isolated from *Arabidopsis thaliana* plants, and cloned into a Ti plasmid vector, CRS338, under the control of a 35S promoter, p32449 promoter, or p326 promoter, as indicated. Each construct contained a phosphinothricin acetyltransferase gene which confers Finale™ resistance to transformed plants. Wild-type *Arabidopsis thaliana* ecotype Wassilewskija (Ws) plants were transformed separately with each construct. The transformations were performed essentially as described in Bechtold et al., *C. R. Acad. Sci. Paris,* 316:1194-1199 (1993).

Transgenic *Arabidopsis* lines containing SEQ ID NO:441, SEQ ID NO:488, SEQ ID NO:567, SEQ ID NO:589, SEQ ID NO:704, SEQ ID NO:710, SEQ ID NO:1241, SEQ ID NO:1260, SEQ ID NO:1128, SEQ ID NO:59, SEQ ID NO:363, SEQ ID NO:310, SEQ ID NO:159, SEQ ID NO:1, SEQ ID NO:1008, or SEQ ID NO:56 were designated ME00029, ME00045, ME02190, ME02549, ME02865, ME03227, ME04477, ME18396, ME20095, ME02932, ME18240, ME20867, ME03268, ME06551, Ceres Clone ID No. 100021678, or ME06919, respectively. The presence of each vector containing a nucleic acid described above in the respective transgenic *Arabidopsis* line transformed with the vector was confirmed by Finale™ resistance, PCR amplification from green leaf tissue extract, and/or sequencing of PCR products.

Example 2—Screening for Drought Tolerance in Transgenic *Arabidopsis* Seedlings Soil was made from 60% Sunshine Mix #5 (Sun Gro; Bellevue, Wash., USA) and 40% vermiculite. For each superpool, 3 flats were seeded with about 3000 seeds. Prior to seeding, each flat was watered with 2 L of filtered water and the surface was misted. The flats were covered with a humidity dome and kept in the dark at 4° C. for 3 days.

After 3 days of cold treatment, the flats covered with humidity domes were transferred to a greenhouse and covered with a shade cloth (day 1). The humidity domes were removed on day 4, or when cotyledons are fully expanded. Each flat was watered with 2 L water within 1 day of removing the humidity domes by adding filtered water to the bottom of the flat and allowing 30-45 minutes for absorption of the water. On days 6 and 8, the flats were assessed for Finale™ resistance. On day 10, the no-hole flats were removed from the bottom of each flat to speed soil drying. The flats were watered in no-hole flats as above after 2.5 weeks and 4 weeks. Candidates with increased height, increased branching, normal siliques, larger rosettes, and persistent flowering, as compared to the wild-type Ws seedlings that were grown and treated in the same conditions were selected for analysis in a chronic soil drought assay.

Chronic Soil Drought Assay

Soil was made from 60% Sunshine Mix #5 (Sun Gro; Bellevue, Wash., USA) and 40% vermiculite. For each candidate event, 24 pots were prepared in a 24-pot no-hole flat with 28 grams of dry soil in each pot, and 4 L of filtered water was added to the tray. The water was allowed to soak into the soil and the soil surface was misted before seeding. For each candidate event, 18 pots were seeded with 3-5 seeds each of candidate seeds and 6 pots were seeded with 3-5 seeds each of wild-type control seeds. The seeded pots were covered with a humidity dome and kept in the dark at 4° C. for 3 days.

After 3 days of cold treatment, the pots covered with humidity domes were transferred to a Conviron® growth chamber set at 22° C., 16:8 hour light:dark cycle, 70% humidity, and 120 µE light intensity. The humidity domes were removed on day 5, or when cotyledons are fully expanded. After removal of the domes, each pot was irrigated to saturation with 0.5× Hoagland's solution, allowing the excess solution to drain. Seedlings were then thinned to 1 per pot. On day 8 or 9, the pots were irrigated to saturation with filtered water, allowing the excess water to drain after about 30 minutes of soaking, and the weight of each 24-pot flat was recorded. Each pot contained about 107 g water at saturation. Each pot was allowed to dry to about 15% of saturation between waterings. 30 g of water was added at each watering. Rosette area was measured at day 19. On day 24, plants were staked and measurements were taken of the longest leaf and the plant height. Terminal plant height was measured at the cease of flowering. The plants were allowed to dry and seed weight was measured. Finale resistance of a cauline leaf was determined at day 24. Significance of drought tolerance measurements was assessed using a one-tailed Student's t-test, assuming unequal variance, at $p \leq 0.5$.

Example 3—Screening for Heat Tolerance in Transgenic *Arabidopsis* Seedlings Agar plates were made from the media composed of 2.15 g/L MS salt (PhytoTechnology Laboratories®), 5 g/L sucrose (Sigma), 0.7% agar (PhytoTechnology Laboratories®), pH 5.7. For each superpool, 3000 seeds were sterilized using 30% Clorox containing 0.1% Triton X-100 and plated onto two agar plates at a density of 1500 seeds per plate. The plates were wrapped with vent tape and kept in the dark at 4° C. for 3 days.

After 3 days of stratification, the plates were transferred to a Conviron® growth chamber set at 22° C., 16:8 hour light:dark cycle, 70% humidity, and 60 µE light intensity. The seedlings were grown in the chamber for 3.5-4 days. For heat shock, the plates were placed in an incubator set at 47° C. for 2 hours. After heat shock, the plates were transferred back to the Conviron® growth chamber and the seedlings were allowed to recover and grow for several days (about 7 days). Candidates with enhanced root growth and greenness of leaves, faster emergence of photosynthetically active true leaves and increased size of rosettes, as compared to the wild-type Ws seedlings that were grown and treated in the same conditions were selected for analysis in a heat shock assay.

Heat Shock I Assay

Seeds were plated on heat germination agar plates containing 45 mL of half-strength MS medium (2.15 g MS salt (PhytoTechnology Laboratories®), 5 g sucrose (Sigma), and 0.7% agar (PhytoTechnology Laboratories®) per liter, pH 5.7) per Petri dish (square, 100 mm×15 mm) One transgenic event (40 seeds) and 9 wild-type Ws control seeds were plated on each plate. Plates were wrapped with vent tape and placed in the dark at 4° C. for 3 days. Plates were then transferred into a Conviron® growth chamber set at 22° C., 16:8 hour light:dark cycle, and 70% humidity with fluorescent lamps emitting a light intensity of about 60 µE.

After the plants were grown in the Conviron® growth chamber for 3-4 days, the plates were treated at 47° C. in a Yamato IC800 incubator for 1 hour 50 minutes. Following the heat treatment, the plates were placed immediately back into the Conviron® growth chamber. On the 7th, 9th, and 11th day at 22° C. after the heat treatment, the plates were scanned using Epson Perfection 4870 scanner. The area of each seedling (green area) was quantified using the Win-Rhizo software (Regent Instruments). The transgenic status of each plant was assessed by Finale™ resistance.

The seedling area (a measure of growth after heat treatment) of transgenic plants was compared to that of the pooled controls comprising non-transgenic segregants and wild-type Ws controls grown on the same plate. Significance of heat tolerance was assessed using a one-tailed Student's t-test, assuming unequal variance, at $p \leq 0.5$.

Heat Shock II Assay

Seeds were plated on heat germination agar plates containing 45 mL of half-strength MS medium (2.15 g MS salt (PhytoTechnology Laboratories®), 5 g sucrose (Sigma-Aldrich®), and 0.7% agar (PhytoTechnology Laboratories®) per liter, pH 5.7) per Petri dish (square, 100 mm×15 mm) One transgenic event (30 seeds), 4 wild-type Ws control seeds, and 2 seeds of a transgenic positive control were plated on each plate. Plates were wrapped with vent tape and placed in the dark at 4° C. for 3 days. Plates were then transferred into a Conviron® growth chamber set at 22° C., 16:8 hour light:dark cycle, and 70% humidity with fluorescent lamps emitting a light intensity of about 60 µE.

After the plants were grown in the Conviron® growth chamber for 11 days, the plates were scanned using a CF imager (Technologica) to record the PSII operating efficiency ($\Delta\Phi_{PSII}$) and seedling area. The plates were then transferred to a Conviron® reach-in heat chamber set at 42° C. for 5 hours. Following the heat treatment, the plants were immediately scanned using the CF imager, and then transferred back into the Conviron® growth chamber. After 2 and 4 days of recovery in the growth chamber, the plates were scanned using the CF imager again. The transgenic status of each plant was assessed by Finale™ resistance.

The differences in the PSII operating efficiency and seedling size prior to heat shock, immediately after heat shock, and after recovery following heat shock were calculated. The differences in the PSII operating efficiency and seedling size of transgenic plants were compared to the pooled controls comprising non-transgenic segregants and wild-type Ws controls grown on the same plate. Significance of heat tolerance was assessed using a one-tailed Student's t-test, assuming unequal variance, at p≤0.5.

Example 4—Results for ME00029 Events $T_2$ and $T_3$ seed from two events of ME00029 containing SEQ ID NO:441 under control of a p32449 promoter was analyzed for rosette area, terminal plant height, and seed yield as described in Example 2. The results are provided in Table 1.

TABLE 1

Chronic drought response of seedlings from ME00029

| Plants | Measurement | Control Population | |
|---|---|---|---|
| | | Internal | Pooled |
| $T_2$ seedlings from event-01 of ME00029 | Rosette Area | N.S. | Sig. |
| $T_2$ seedlings from event-04 of ME00029 | Rosette Area | N.A. | Sig. |
| $T_2$ seedlings from event-01 of ME00029 | Longest Leaf | N.S. | Sig. |
| $T_2$ seedlings from event-01 of ME00029 | Terminal Plant Height | Sig. | Sig. |
| $T_3$ seedlings from event-01 of ME00029 | Terminal Plant Height | Sig. | Sig. |
| $T_2$ seedlings from event-04 of ME00029 | Terminal Plant Height | N.A. | Sig. |
| $T_3$ seedlings from event-04 of ME00029 | Terminal Plant Height | N.A. | Sig. |
| $T_3$ seedlings from event-01 of ME00029 | Seed Yield | N.S. | Sig. |

N.A.—results not available due to insufficient sample size (n < 5);
N.S.—not significant;
Sig.—significant (p ≤ 0.5).

Example 5—Results for ME00045 Events $T_2$ and $T_3$ seed from three events of ME00045 containing SEQ ID NO:488 under control of a p32449 promoter was analyzed for rosette area, terminal plant height, longest leaf length, and seed yield as described in Example 2. The results are provided in Table 2.

TABLE 2

Chronic drought response of seedlings from ME00045

| Plants | Measurement | Control Population | | |
|---|---|---|---|---|
| | | Internal | Pooled | Ws |
| $T_3$ seedlings from event-02 of ME00045 | Rosette Area | N.S. | N.S. | Sig. |
| $T_3$ seedlings from event-02 of ME00045 | Rosette Area | N.S. | N.S. | N.S. |
| $T_2$ seedlings from event-07 of ME00045 | Rosette Area | N.A. | N.S. | Sig. |
| $T_2$ seedlings from event-07 of ME00045 | Rosette Area | N.S. | N.S. | Sig. |
| $T_2$ seedlings from event-08 of ME00045 | Rosette Area | N.A. | N.S. | Sig. |
| $T_2$ seedlings from event-08 of ME00045 | Rosette Area | N.S. | N.S. | N.S. |
| $T_3$ seedlings from event-02 of ME00045 | Longest Leaf | Sig. | Sig. | Sig. |
| $T_3$ seedlings from event-02 of ME00045 | Longest Leaf | N.S. | N.S. | N.S. |
| $T_2$ seedlings from event-07 of ME00045 | Longest Leaf | N.A. | N.S. | Sig. |
| $T_2$ seedlings from event-07 of ME00045 | Longest Leaf | N.S. | N.S. | N.S. |
| $T_2$ seedlings from event-08 of ME00045 | Longest Leaf | N.A. | N.S. | Sig. |
| $T_2$ seedlings from event-08 of ME00045 | Longest Leaf | N.S. | N.S. | N.S. |
| $T_3$ seedlings from event-02 of ME00045 | Terminal Plant Height | N.S. | N.S. | N.S. |
| $T_3$ seedlings from event-02 of ME00045 | Terminal Plant Height | N.S. | N.S. | N.S.* |
| $T_2$ seedlings from event-07 of ME00045 | Terminal Plant Height | N.A. | Sig. | Sig. |
| $T_2$ seedlings from event-07 of ME00045 | Terminal Plant Height | N.S. | Sig. | Sig. |
| $T_2$ seedlings from event-08 of ME00045 | Terminal Plant Height | N.A. | N.S.* | N.S. |
| $T_2$ seedlings from event-08 of ME00045 | Terminal Plant Height | N.S. | N.S. | Sig. |
| $T_3$ seedlings from event-02 of ME00045 | Seed Yield | Sig. | N.S.* | Sig. |
| $T_3$ seedlings from event-02 of ME00045 | Seed Yield | N.S. | N.S. | N.S. |
| $T_2$ seedlings from event-07 of ME00045 | Seed Yield | N.A. | N.S. | N.S. |
| $T_2$ seedlings from event-07 of ME00045 | Seed Yield | N.S. | N.S. | N.S. |
| $T_2$ seedlings from event-08 of ME00045 | Seed Yield | N.A. | N.S.* | Sig. |
| $T_2$ seedlings from event-08 of ME00045 | Seed Yield | N.S. | N.S. | Sig. |

N.A.—results not available due to insufficient sample size;
N.S.—not significant (p > 0.10);
N.S.*—not significant (0.5 < p < 0.10);
Sig.—significant (p < 0.5).
Data in bold represents a second independent replicate.

Example 6—Results for ME02190 Events $T_2$ and $T_4$ seed from two events of ME02190 containing SEQ ID NO:567 under control of a 35S promoter was analyzed for rosette area, terminal plant height, and longest leaf length as described in Example 2. The results are provided in Table 3.

TABLE 3

Chronic drought response of seedlings from ME02190

| Plants | Measurement | Control Population | |
|---|---|---|---|
| | | Internal | Pooled |
| $T_2$ seedlings from event-10 of ME02190 | Rosette Area | N.S. | Sig. |
| $T_4$ seedlings from event-02 of ME02190 | Longest Leaf | N.A. | Sig. |
| $T_2$ seedlings from event-10 of ME02190 | Longest Leaf | N.S. | Sig. |

TABLE 3-continued

Chronic drought response of seedlings from ME02190

| Plants | Measurement | Control Population | |
|---|---|---|---|
| | | Internal | Pooled |
| $T_4$ seedlings from event-02 of ME02190 | Terminal Plant Height | N.A. | Sig. |
| $T_2$ seedlings from event-10 of ME02190 | Terminal Plant Height | N.S. | Sig. |

N.A.—results not available due to insufficient sample size (n < 5);
N.S.—not significant;
Sig.—significant (p ≤ 0.5).

Example 7—Results for ME02549 Events $T_2$ and $T_3$ seed from three events of ME02549 containing SEQ ID NO:589 under control of a 35S promoter was analyzed for rosette area, terminal plant height, and longest leaf length as described in Example 2. The results are provided in Table 4.

TABLE 4

Chronic drought response of seedlings from ME02549

| Plants | Measurement | Control Population | | |
|---|---|---|---|---|
| | | Internal | Pooled | Ws |
| $T_2$ seedlings from event-01 of ME02549 | Rosette Area | Sig. | N.S. | Sig. |
| $T_3$ seedlings from event-01 of ME02549 | Rosette Area | Sig. | N.S. | N.S. |
| $T_2$ seedlings from event-02 of ME02549 | Rosette Area | N.S.* | N.S.* | Sig. |
| $T_3$ seedlings from event-02 of ME02549 | Rosette Area | N.S. | N.S. | Sig. |
| $T_2$ seedlings from event-05 of ME02549 | Rosette Area | N.A. | N.S. | Sig. |
| $T_3$ seedlings from event-05 of ME02549 | Rosette Area | N.S. | N.S.* | Sig. |
| $T_3$ seedlings from event-01 of ME02549 | Longest Leaf | N.S. | N.S. | Sig. |
| $T_3$ seedlings from event-02 of ME02549 | Longest Leaf | N.S. | N.S. | Sig. |
| $T_3$ seedlings from event-05 of ME02549 | Longest Leaf | N.S. | N.S. | Sig. |
| $T_2$ seedlings from event-01 of ME02549 | Terminal Plant Height | N.A. | N.S. | N.S. |
| $T_3$ seedlings from event-01 of ME02549 | Terminal Plant Height | N.S. | N.S. | Sig. |
| $T_3$ seedlings from event-02 of ME02549 | Terminal Plant Height | N.S. | Sig. | Sig. |
| $T_2$ seedlings from event-05 of ME02549 | Terminal Plant Height | N.A. | N.S. | N.S. |
| $T_3$ seedlings from event-05 of ME02549 | Terminal Plant Height | Sig. | N.S. | Sig. |

N.A.—results not available due to insufficient sample size (n < 5);
N.S.—not significant;
N.S.*—not significant (0.5 < p < 0.10);
Sig.—significant (p < 0.5).

Example 8—Results for ME02865 Events $T_2$ and $T_3$ seed from two events of ME02865 containing SEQ ID NO:704 under control of a 35S promoter was analyzed for rosette area, terminal plant height, longest leaf length, and seed weight as described in Example 2. The results are provided in Table 5.

TABLE 5

Chronic drought response of seedlings from ME02865

| Plants | Measurement | Control Population | |
|---|---|---|---|
| | | Internal | Pooled |
| $T_2$ seedlings from event-02 of ME02865 | Rosette Area | N.S. | N.S. |
| $T_3$ seedlings from event-02-01 of ME02865 | Rosette Area | — | N.S. |
| $T_3$ seedlings from event-02-02 of ME02865 | Rosette Area | N.S. | N.S. |
| $T_2$ seedlings from event-05 of ME02865 | Rosette Area | —. | Sig. |
| $T_3$ seedlings from event-05-01 of ME02865 | Rosette Area | — | Sig. |
| $T_3$ seedlings from event-05-02 of ME02865 | Rosette Area | N.S. | N.S. |
| $T_2$ seedlings from event-02 of ME02865 | Longest Leaf | N.S. | N.S. |
| $T_3$ seedlings from event-02-01 of ME02865 | Longest Leaf | — | N.S. |
| $T_3$ seedlings from event-02-02 of ME02865 | Longest Leaf | N.S.* | Sig. |
| $T_2$ seedlings from event-05 of ME02865 | Longest Leaf | — | Sig. |
| $T_3$ seedlings from event-05-01 of ME02865 | Longest Leaf | — | N.S. |
| $T_3$ seedlings from event-05-02 of ME02865 | Longest Leaf | N.S. | Sig. |
| $T_2$ seedlings from event-02 of ME02865 | Terminal Plant Height | Sig. | Sig. |
| $T_3$ seedlings from event-02-01 of ME02865 | Terminal Plant Height | — | N.S.* |
| $T_3$ seedlings from event-02-02 of ME02865 | Terminal Plant Height | N.S. | Sig. |
| $T_2$ seedlings from event-05 of ME02865 | Terminal Plant Height | — | Sig. |
| $T_3$ seedlings from event-05-01 of ME02865 | Terminal Plant Height | — | N.S.* |
| $T_3$ seedlings from event-05-02 of ME02865 | Terminal Plant Height | N.S.* | Sig. |
| $T_2$ seedlings from event-02 of ME02865 | Seed Weight | N.S. | N.S. |
| $T_3$ seedlings from event-02-01 of ME02865 | Seed Weight | — | N.S. |
| $T_3$ seedlings from event-02-02 of ME02865 | Seed Weight | Sig. | N.S. |
| $T_2$ seedlings from event-05 of ME02865 | Seed Weight | — | Sig. |
| $T_3$ seedlings from event-05-01 of ME02865 | Seed Weight | — | N.S. |
| $T_3$ seedlings from event-05-02 of ME02865 | Seed Weight | N.S. | N.S.* |

N.A.—results not available due to insufficient sample size (n < 5);
N.S.—not significant;
N.S.*—not significant (0.5 < p < 0.10);
Sig.—significant (p < 0.5).

The physical appearances of $T_1$ ME02865 plants were similar to those of corresponding control plants grown under standard conditions. There were no observable or statistically significant differences between $T_2$ plants from events −02 and −05 of ME02865 and control plants in germination, onset of flowering, rosette area, fertility, and general morphology/architecture when grown under standard conditions.

Example 9—Results for ME03227 Events $T_2$ and $T_3$ seed from two events of ME03227 containing SEQ ID NO:710 under control of a 35S promoter was analyzed for rosette area, terminal plant height, and longest leaf length as described in Example 2. The results are provided in Table 6.

TABLE 6

Chronic drought response of seedlings from ME03227

| Plants | Measurement | Control Population Internal | Control Population Pooled |
|---|---|---|---|
| $T_2$ seedlings from event-01 of ME03227 | Rosette Area | N.A. | Sig. |
| $T_3$ seedlings from event-01 of ME03227 | Rosette Area | N.A. | Sig. |
| $T_2$ seedlings from event-05 of ME03227 | Rosette Area | N.A. | Sig. |
| $T_3$ seedlings from event-05 of ME03227 | Rosette Area | N.A. | Sig. |
| $T_3$ seedlings from event-05 of ME03227 | Longest Leaf | N.A. | Sig. |
| $T_3$ seedlings from event-01 of ME03227 | Terminal Plant Height | N.A. | N.S.* |
| $T_3$ seedlings from event-05 of ME03227 | Terminal Plant Height | N.A. | N.S.* |

N.A.—results not available due to insufficient sample size (n < 5);
N.S.—not significant;
N.S.*—not significant (0.5 < p < 0.10);
Sig.—significant (p ≤ 0.5).

Example 10—Results for ME04477 Events $T_2$ seed from five events of ME04477 containing SEQ ID NO:1241 under control of a 35S promoter was analyzed for rosette area, terminal plant height, and longest leaf length as described in Example 2. The results are provided in Table 7.

TABLE 7

Chronic drought response of seedlings from ME04477

| Plants | Measurement | Control Population Internal | Control Population Pooled |
|---|---|---|---|
| $T_2$ seedlings from event-03 of ME04477 | Rosette Area | N.A. | Sig. |
| $T_2$ seedlings from event-01 of ME04477 | Longest Leaf | N.A. | Sig. |
| $T_2$ seedlings from event-02 of ME04477 | Longest Leaf | N.A. | Sig. |
| $T_2$ seedlings from event-03 of ME04477 | Longest Leaf | N.A. | Sig. |
| $T_2$ seedlings from event-04 of ME04477 | Longest Leaf | Sig. | Sig. |
| $T_2$ seedlings from event-05 of ME04477 | Longest Leaf | N.A. | Sig. |
| $T_2$ seedlings from event-01 of ME04477 | Terminal Plant Height | N.A. | Sig. |
| $T_2$ seedlings from event-02 of ME04477 | Terminal Plant Height | N.A. | Sig. |
| $T_2$ seedlings from event-03 of ME04477 | Terminal Plant Height | N.A. | Sig. |
| $T_2$ seedlings from event-04 of ME04477 | Terminal Plant Height | Sig. | Sig. |
| $T_2$ seedlings from event-05 of ME04477 | Terminal Plant Height | N.A. | Sig. |

N.A.—results not available due to insufficient sample size (n < 5);
N.S.—not significant;
Sig.—significant (p < 0.5).

Example 11—Results for ME18396 Events $T_2$ seed from one event of ME18396 containing SEQ ID NO:1260 under control of a p326 promoter was analyzed for rosette area and terminal plant height as described in Example 2. The results are provided in Table 8.

TABLE 8

Chronic drought response of seedlings from ME18396

| Plants | Measurement | Control Population Internal | Control Population Pooled |
|---|---|---|---|
| $T_2$ seedlings from event-02 of ME18396 | Rosette Area | N.S. | Sig. |
| $T_2$ seedlings from event-02 of ME18396 | Terminal Plant Height | Sig. | Sig. |

N.S.—not significant;
Sig.—significant (p < 0.5).

Example 12—Results for ME20095 Events $T_2$ and $T_3$ seed from two events of ME20095 containing SEQ ID NO:1128 under control of a 35S promoter was analyzed for rosette area, longest leaf length, terminal plant height, and seed yield as described in Example 2. The results are provided in Table 9.

TABLE 9

Chronic drought response of seedlings from ME20095

| Plants | Measurement | Control Population Internal | Control Population Pooled |
|---|---|---|---|
| $T_2$ seedlings from event-01 of ME20095 | Rosette Area | Sig. | Sig. |
| $T_3$ seedlings from event-01-01 of ME20095 | Rosette Area | N.S. | N.S. |
| $T_3$ seedlings from event-01-02 of ME20095 | Rosette Area | N.S. | N.S. |
| $T_2$ seedlings from event-04 of ME20095 | Rosette Area | Sig. | Sig. |
| $T_3$ seedlings from event-04-01 of ME20095 | Rosette Area | N.S. | N.S. |
| $T_3$ seedlings from event-04-02 of ME20095 | Rosette Area | N.S. | N.S.* |
| $T_2$ seedlings from event-01 of ME20095 | Longest Leaf | N.S. | Sig. |
| $T_3$ seedlings from event-01-01 of ME20095 | Longest Leaf | Sig. | Sig. |
| $T_3$ seedlings from event-01-02 of ME20095 | Longest Leaf | N.S. | N.S. |
| $T_2$ seedlings from event-04 of ME20095 | Longest Leaf | Sig. | Sig. |
| $T_3$ seedlings from event-04-01 of ME20095 | Longest Leaf | Sig. | Sig. |
| $T_3$ seedlings from event-04-02 of ME20095 | Longest Leaf | N.S.* | Sig. |
| $T_2$ seedlings from event-01 of ME20095 | Terminal Plant Height | N.S. | Sig. |
| $T_3$ seedlings from event-01-01 of ME20095 | Terminal Plant Height | N.S.* | Sig. |
| $T_3$ seedlings from event-01-02 of ME20095 | Terminal Plant Height | N.S. | N.S.* |
| $T_2$ seedlings from event-04 of ME20095 | Terminal Plant Height | Sig. | Sig. |
| $T_3$ seedlings from event-04-01 of ME20095 | Terminal Plant Height | Sig. | Sig. |
| $T_3$ seedlings from event-04-02 of ME20095 | Terminal Plant Height | N.S. | Sig. |
| $T_2$ seedlings from event-01 of ME20095 | Seed Weight | Sig. | Sig. |
| $T_3$ seedlings from event-01-01 of ME20095 | Seed Weight | Sig. | N.S.* |
| $T_3$ seedlings from event-01-02 of ME20095 | Seed Weight | Sig. | Sig. |
| $T_2$ seedlings from event-04 of ME20095 | Seed Weight | N.S. | N.S. |

TABLE 9-continued

Chronic drought response of seedlings from ME20095

| Plants | Measurement | Control Population | |
|---|---|---|---|
| | | Internal | Pooled |
| $T_3$ seedlings from event-04-01 of ME20095 | Seed Weight | N.S. | N.S. |
| $T_3$ seedlings from event-04-02 of ME20095 | Seed Weight | N.S. | N.S. |

N.S.—not significant;
N.S.*—not significant (0.5 < p < 0.10);
Sig.—significant (p < 0.5).

$T_1$ ME20095 plants showed delayed flowering and prolonged vegetative growth compared to corresponding control plants grown under standard conditions. There were no observable or statistically significant differences between $T_2$ plants from events −02 and −04 of ME20095 and control plants in germination, onset of flowering, fertility, and general morphology/architecture when grown under standard conditions. Rosette area in T2 plants from events −02 and −04 was significantly larger and seed yield was increased as compared to corresponding control plants grown under standard conditions.

Example 13—Results for ME02401 Events

T2 and T3 seed from two events of ME02401 containing SEQ ID NO:749 under control of a 35S promoter was analyzed for rosette area, terminal plant height, and longest leaf length as described in Example 2. The results are provided in Table 10.

TABLE 10

Chronic drought response of seedlings from ME02401

| Plants | Measurement | Control Population | |
|---|---|---|---|
| | | Internal | Pooled |
| $T_2$ seedlings from event-05 of ME02401 | Rosette Area | N.A. | N.S.* |
| $T_3$ seedlings from event-01 of ME02401 | Longest Leaf | N.S.* | Sig. |
| $T_2$ seedlings from event-05 of ME02401 | Longest Leaf | N.A. | Sig. |
| $T_3$ seedlings from event-01 of ME02401 | Terminal Plant Height | Sig. | Sig. |
| $T_2$ seedlings from event-05 of ME02401 | Terminal Plant Height | N.A. | Sig. |

N.A.—results not available due to insufficient sample size (n < 5);
N.S.—not significant;
N.S.*—not significant (0.5 < p < 0.10);
Sig.—significant (p < 0.5).

Example 14—Results for ME02932 Events $T_2$ and $T_3$ seed from two events of ME02932 containing SEQ ID NO:59 under control of a 35S promoter was analyzed for seedling area following a Heat Shock I assay as described in Example 3. The results are provided in Table 11.

TABLE 11

ME02932 seedling area following Heat Shock I assay

| Plants | Average seedling area | SE | N | p-value |
|---|---|---|---|---|
| $T_2$ seedlings from event-01 of ME02932 | 0.07 | 0.008 | 33 | 8.77E−04 |
| $T_2$ non-transgenic segregants of event-01 of ME02932 | 0.04 | 0.006 | 15 | |
| $T_3$ seedlings from event-01 of ME02932 | 0.10 | 0.003 | 40 | 2.21E−04 |
| $T_3$ non-transgenic segregants of event-01 of ME02932 | 0.07 | 0.007 | 9 | |
| $T_2$ seedlings from event-03 of ME02932 | 0.08 | 0.012 | 21 | 1.29E−02 |
| $T_2$ non-transgenic segregants of event-03 of ME02932 | 0.04 | 0.009 | 23 | |
| $T_3$ seedlings from event-03 of ME02932 | 0.09 | 0.004 | 36 | 1.54E−03 |
| $T_3$ non-transgenic segregants of event-03 of ME02932 | 0.07 | 0.005 | 13 | |

The physical appearances of $T_1$ ME02932 plants were similar to those of corresponding control plants grown under standard conditions. There were no observable or statistically significant differences between $T_2$ plants from events −01 and −03 of ME02932 and control plants in germination, onset of flowering, rosette area, fertility, and general morphology/architecture when grown under standard conditions.

Example 15—Results for ME18240 Events $T_2$ and $T_3$ seed from three events of ME18240 containing SEQ ID NO:363 under control of a 35S promoter was analyzed for seedling area following a Heat Shock I assay and change in photosynthetic activity during a Heat Shock II assay as described in Example 3. The results are provided in Tables 12 and 13.

TABLE 12

ME18240 seedling area following Heat Shock I assay

| Plants | Average seedling area | SE | N | p-value |
|---|---|---|---|---|
| $T_2$ seedlings from event-02 of ME18240 | 0.08 | 0.007 | 27 | 4.22E−08 |
| $T_2$ non-transgenic segregants of event-02 of ME18240 | 0.03 | 0.004 | 16 | |
| $T_3$ seedlings from event-02 of ME18240 | 0.14 | 0.007 | 31 | 5.83E−11 |
| $T_3$ non-transgenic segregants of event-02 of ME18240 | 0.06 | 0.007 | 14 | |
| $T_2$ seedlings from event-03 of ME18240 | 0.13 | 0.007 | 35 | 3.31E−05 |
| $T_2$ non-transgenic segregants of event-03 of ME18240 | 0.08 | 0.01 | 14 | |
| $T_3$ seedlings from event-03 of ME18240 | 0.14 | 0.008 | 28 | 5.13E−06 |
| $T_3$ non-transgenic segregants of event-03 o fME18240 | 0.09 | 0.008 | 19 | |
| $T_2$ seedlings from event-04 of ME18240 | 0.13 | 0.008 | 33 | 2.39E−07 |
| $T_2$ non-transgenic segregants of event-04 of ME18240 | 0.06 | 0.009 | 16 | |
| $T_3$ seedlings from event-04 of ME18240 | 0.13 | 0.008 | 29 | 4.68E−05 |
| $T_3$ non-transgenic segregants of event-04 of ME18240 | 0.08 | 0.008 | 18 | |

TABLE 13

ME18240 ΔFv/Fm in response to Heat Shock II assay

| Plants | Average ΔFv/Fm | SE | N | p-value |
|---|---|---|---|---|
| $T_2$ seedlings from event-02 of ME18240 | 0.24 | 0.013 | 47 | 3.64E−05 |
| $T_2$ non-transgenic segregants of event-02 of ME18240 | 0.32 | 0.016 | 25 | |
| $T_3$ seedlings from event-02 of ME18240 | 0.36 | 0.012 | 43 | 1.92E−04 |
| $T_3$ non-transgenic segregants of event-02 of ME18240 | 0.43 | 0.016 | 22 | |
| $T_2$ seedlings from event-03 of ME18240 | 0.24 | 0.010 | 41 | 9.27E−11 |
| $T_2$ non-transgenic segregants of event-03 of ME18240 | 0.37 | 0.011 | 28 | |
| $T_3$ seedlings from event-03 of ME18240 | 0.33 | 0.011 | 24 | 1.91E−02 |
| $T_3$ non-transgenic segregants of event-03 of ME18240 | 0.39 | 0.022 | 10 | |
| $T_2$ seedlings from event-04 of ME18240 | 0.21 | 0.009 | 43 | 5.55E−17 |
| $T_2$ non-transgenic segregants of event-04 of ME18240 | 0.40 | 0.007 | 29 | |
| $T_3$ seedlings from event-04 of ME18240 | 0.28 | 0.011 | 46 | 9.38E−11 |
| $T_3$ non-transgenic segregants of event-04 of ME18240 | 0.41 | 0.008 | 21 | |

Where ΔFv/Fm = Fv/Fm prior to heat shock − Fv/Fm after heat shock.

The physical appearances of $T_1$ ME18240 plants were similar to those of corresponding control plants grown under standard conditions. There were no observable or statistically significant differences between $T_2$ plants from events −02, −03, and −04 of ME18240 and control plants in germination, onset of flowering, rosette area, fertility, and general morphology/architecture when grown under standard conditions.

Example 16—Results for ME20867 Events $T_2$ and $T_3$ seed from four events of ME20867 containing SEQ ID NO:310 under control of a 35S promoter was analyzed for seedling area following a Heat Shock I assay and change in photosynthetic activity during a Heat Shock II assay as described in Example 3. The results are provided in Tables 14 and 15.

TABLE 14

ME20867 seedling area in response to Heat Shock I assay

| Plants | Average seedling area | SE | N | p-value |
|---|---|---|---|---|
| $T_2$ seedlings from event-01 of ME20867 | 0.14 | 0.008 | 28 | 4.86E−07 |
| $T_2$ non-transgenic segregants of event-01 of ME20867 | 0.07 | 0.011 | 12 | |
| $T_3$ seedlings from event-01 of ME20867 | 0.07 | 0.007 | 31 | 9.84E−10 |
| $T_3$ non-transgenic segregants of event-01 of ME20867 | 0.01 | 0.010 | 16 | |
| $T_2$ seedlings from event-02 of ME20867 | 0.13 | 0.006 | 37 | 1.03E−02 |
| $T_2$ non-transgenic segregants of event-02 of ME20867 | 0.08 | 0.024 | 3 | |
| $T_3$ seedlings from event-02 of ME20867 | 0.09 | 0.006 | 32 | 6.01E−07 |
| $T_3$ non-transgenic segregants of event-02 of ME20867 | 0.02 | 0.011 | 9 | |
| $T_2$ seedlings from event-04 of ME20867 | 0.12 | 0.006 | 31 | 1.47E−02 |
| $T_2$ non-transgenic segregants of event-04 of ME20867 | 0.10 | 0.010 | 9 | |
| $T_3$ seedlings from event-04 of ME20867 | 0.03 | 0.005 | 20 | 2.14E−04 |
| $T_3$ non-transgenic segregants of event-04 of ME20867 | 0.01 | 0.007 | 12 | |
| $T_2$ seedlings from event-05 of ME20867 | 0.11 | 0.009 | 30 | 1.51E−02 |
| $T_2$ non-transgenic segregants of event-05 of ME20867 | 0.08 | 0.012 | 10 | |
| $T_3$ seedlings from event-05 of ME20867 | 0.03 | 0.004 | 23 | 1.98E−04 |
| $T_3$ non-transgenic segregants of event-05 of ME20867 | 0.01 | 0.005 | 20 | |

TABLE 15

ME20867 ΔFv/Fm − $D_2$ in response to Heat Shock II assay

| Plants | Average ΔFv/Fm − $D_2$ | SE | N | p-value |
|---|---|---|---|---|
| $T_2$ seedlings from event-01 of ME20867 | 0.03 | 0.012 | 33 | 2.17E−08 |
| $T_2$ non-transgenic segregants of event-01 of ME20867 | −0.07 | 0.008 | 12 | |
| $T_3$ seedlings from event-01 of ME20867 | 0.21 | 0.010 | 44 | 3.71E−12 |
| $T_3$ non-transgenic segregants of event-01 of ME20867 | 0.06 | 0.015 | 22 | |
| $T_2$ seedlings from event-02 of ME20867 | 0.06 | 0.011 | 25 | 9.39E−11 |
| $T_2$ non-transgenic segregants of event-02 of ME20867 | −0.10 | 0.006 | 12 | |
| $T_3$ seedlings from event-02 of ME20867 | 0.25 | 0.012 | 50 | 4.79E−08 |
| $T_3$ non-transgenic segregants of event-02 of ME20867 | 0.06 | 0.029 | 16 | |
| $T_2$ seedlings from event-04 of ME20867 | 0.17 | 0.010 | 43 | 8.71E−11 |
| $T_2$ non-transgenic segregants of event-04 of ME20867 | 0.03 | 0.014 | 22 | |
| $T_3$ seedlings from event-04 of ME20867 | 0.16 | 0.011 | 24 | 1.39E−03 |
| $T_3$ non-transgenic segregants of event-04 of ME20867 | 0.06 | 0.027 | 9 | |
| $T_2$ seedlings from event-05 of ME20867 | 0.21 | 0.016 | 28 | 1.35E−09 |
| $T_2$ non-transgenic segregants of event-05 of ME20867 | 0.07 | 0.012 | 31 | |
| $T_3$ seedlings from event-05 of ME20867 | 0.24 | 0.015 | 19 | 3.72E−03 |
| $T_3$ non-transgenic segregants of event-05 of ME20867 | 0.18 | 0.015 | 14 | |

ΔFv/Fm − $D_2$ = Fv/Fm immediately after heat shock − Fv/Fm after 2 days recovery.

The physical appearances of $T_1$ ME20867 plants were similar to those of corresponding control plants grown under standard conditions. There were no observable or statistically significant differences between $T_2$ plants from events −01, −02, −04 and −05 of ME20867 and control plants in germination, onset of flowering, rosette area, fertility, and general morphology/architecture when grown under standard conditions.

Example 17—Results for ME03268 Events $T_2$ and $T_3$ seed from one event of ME03268, and $T_3$ and $T_4$ seed from one event of ME03268, each containing SEQ ID NO:159 under control of a 35S promoter, was analyzed for seedling area following a Heat Shock I assay as described in Example 3. The results are provided in Table 16.

TABLE 16

ME03268 seedling area in response to Heat Shock I assay

| Plants | Average seedling area | SE | N | p-value |
|---|---|---|---|---|
| $T_2$ seedlings from event-02 of ME03268 | 0.165 | 0.015 | 26 | 1.09E−03 |
| $T_2$ non-transgenic segregants of event-02 of ME03268 | 0.070 | 0.024 | 3 | |

TABLE 16-continued

ME03268 seedling area in response to Heat Shock I assay

| Plants | Average seedling area | SE | N | p-value |
|---|---|---|---|---|
| $T_3$ seedlings from event-02 of ME03268 | 0.137 | 0.009 | 40 | 1.97E−07 |
| $T_3$ non-transgenic segregants of event-02 of ME03268 | 0.048 | 0.012 | 9 | |
| $T_3$ seedlings from event-03 of ME03268 | 0.062 | 0.007 | 26 | 3.65E−02 |
| $T_3$ non-transgenic segregants of event-03 of ME03268 | 0.037 | 0.011 | 4 | |
| $T_4$ seedlings from event-03 of ME03268 | 0.094 | 0.008 | 30 | 3.96E−03 |
| $T_4$ non-transgenic segregants of event-03 of ME03268 | 0.054 | 0.012 | 10 | |

The physical appearances of $T_1$ ME03268 plants were similar to those of corresponding control plants grown under standard conditions. There were no observable or statistically significant differences between $T_2$ plants from events −02 and −03 of ME03268 and control plants in germination, onset of flowering, rosette area, fertility, and general morphology/architecture when grown under standard conditions.

Example 18—Results for ME06551 Events $T_3$ and $T_4$ seed from two events of ME06551 containing SEQ ID NO:1 under control of a 35S promoter was analyzed for change in photosynthetic activity during a Heat Shock II assay as described in Example 3. The results are provided in Table 17.

TABLE 17

ME06551 ΔFv/Fm in response to Heat Shock II assay

| Plants | Average ΔFv/Fm | SE | N | p-value |
|---|---|---|---|---|
| $T_3$ seedlings from event-04 of ME06551 | 0.42 | 0.016 | 11 | 1.32E−02 |
| $T_3$ non-transgenic segregants of event-04 of ME06551 | 0.47 | 0.012 | 15 | |
| $T_4$ seedlings from event-04 of ME06551 | 0.39 | 0.006 | 49 | 4.73E−03 |
| $T_4$ non-transgenic segregants of event-04 of ME06551 | 0.43 | 0.014 | 11 | |
| $T_3$ seedlings from event-05 of ME06551 | 0.39 | 0.013 | 11 | 4.21E−04 |
| $T_3$ non-transgenic segregants of event-05 of ME06551 | 0.46 | 0.010 | 13 | |
| $T_4$ seedlings from event-05 of ME06551 | 0.39 | 0.007 | 50 | 4.79E−02 |
| $T_4$ non-transgenic segregants of event-05 of ME06551 | 0.41 | 0.010 | 17 | |

Where ΔFv/Fm = Fv/Fm prior to heat shock − Fv/Fm after heat shock.

The physical appearances of $T_1$ ME06551 plants were similar to those of corresponding control plants grown under standard conditions. There were no observable or statistically significant differences between $T_2$ plants from events −04 and −05 of ME06551 and control plants in germination, onset of flowering, rosette area, fertility, and general morphology/architecture when grown under standard conditions.

Example 19—Results for ME06919 Events $T_2$ and $T_3$ seed from two events of ME06919 containing SEQ ID NO:56 under control of a 35S promoter was analyzed for change in photosynthetic activity during a Heat Shock II assay as described in Example 3. The results are provided in Table 18.

TABLE 18

ME06919 ΔFv/Fm in response to Heat Shock II assay

| Plants | Average ΔFv/Fm | SE | N | p-value |
|---|---|---|---|---|
| $T_2$ seedlings from event-03 of ME06919 | 0.433 | 0.007 | 65 | 2.55E−09 |
| $T_2$ non-transgenic segregants of event-03 of ME06919 | 0.497 | 0.008 | 37 | |
| $T_3$ seedlings from event-03 of ME06919 | 0.281 | 0.013 | 46 | 1.87E−03 |
| $T_3$ non-transgenic segregants of event-03 of ME06919 | 0.341 | 0.015 | 18 | |
| $T_2$ seedlings from event-04 of ME06919 | 0.490 | 0.007 | 21 | 3.06E−04 |
| $T_2$ non-transgenic segregants of event-04 of ME06919 | 0.531 | 0.009 | 26 | |
| $T_3$ seedlings from event-04 of ME06919 | 0.296 | 0.006 | 44 | 6.15E−08 |
| $T_3$ non-transgenic segregants of event-04 of ME06919 | 0.412 | 0.018 | 18 | |

Where ΔFv/Fm = Fv/Fm prior to heat shock − Fv/Fm after heat shock.

The physical appearances of $T_1$ ME06919 plants were similar to those of corresponding control plants grown under standard conditions. There were no observable or statistically significant differences between $T_2$ plants from events −03 and −04 of ME06919 and control plants in germination, onset of flowering, rosette area, fertility, and general morphology/architecture when grown under standard conditions.

Example 20—Results for ME04246 Events $T_2$ and $T_3$ seed from two events of ME04246 containing SEQ ID NO:1362 under control of a 35S promoter was analyzed for rosette area, terminal plant height, and longest leaf length as described in Example 2. The results are provided in Table 19.

TABLE 19

Chronic drought response of seedlings from ME04246

| | | Control Population | | |
|---|---|---|---|---|
| Plants | Measurement | Internal | Pooled | Ws |
| $T_2$ seedlings from event-01 of ME04246 | Longest Leaf | Sig. | Sig. | N.S. |
| $T_2$ seedlings from event-03 of ME04246 | Longest Leaf | N.S. | N.S. | N.S. |
| $T_2$ seedlings from event-04 of ME04246 | Longest Leaf | N.S. | N.S. | N.S. |
| $T_2$ seedlings from event-01 of ME04246 | Dry Biomass | N.A. | N.S.* | Sig. |
| $T_2$ seedlings from event-02 of ME04246 | Dry Biomass | N.A. | N.A. | N.S. |
| $T_2$ seedlings from event-04 of ME04246 | Dry Biomass | N.A. | N.S.* | Sig. |

N.A.—results not available due to insufficient sample size (n < 5);
N.S.—not significant;
N.S.*—not significant (0.5 < p < 0.10);
Sig.—significant (p < 0.5).

$T_2$ ME04246 plants showed increased vegetative biomass compared to corresponding control plants under water-limiting conditions as measured directly and to a lesser degree by longest leaf length. There were no observable or statistically significant differences between $T_1$ plants from events −01, −03 and −04 of ME04246 and control plants in germination, onset of flowering, fertility, and general morphology/architecture when grown under standard conditions.

Example 21—Determination of Functional Homologs by Reciprocal BLAST

A candidate sequence was considered a functional homolog of a reference sequence if the candidate and reference sequences encoded proteins having a similar function and/or activity. A process known as Reciprocal BLAST (Rivera et al., *Proc. Natl. Acad. Sci. USA,* 95:6239-6244 (1998)) was used to identify potential functional homolog sequences from databases consisting of all available public and proprietary peptide sequences, including NR from NCBI and peptide translations from Ceres clones.

Before starting a Reciprocal BLAST process, a specific reference polypeptide was searched against all peptides from its source species using BLAST in order to identify polypeptides having BLAST sequence identity of 80% or greater to the reference polypeptide and an alignment length of 85% or greater along the shorter sequence in the alignment. The reference polypeptide and any of the aforementioned identified polypeptides were designated as a cluster.

The BLASTP version 2.0 program from Washington University at Saint Louis, Mo., USA was used to determine BLAST sequence identity and E-value. The BLASTP version 2.0 program includes the following parameters: 1) an E-value cutoff of 1.0e-5; 2) a word size of 5; and 3) the -postsw option. The BLAST sequence identity was calculated based on the alignment of the first BLAST HSP (High-scoring Segment Pairs) of the identified potential functional homolog sequence with a specific reference polypeptide. The number of identically matched residues in the BLAST HSP alignment was divided by the HSP length, and then multiplied by 100 to get the BLAST sequence identity. The HSP length typically included gaps in the alignment, but in some cases gaps were excluded.

The main Reciprocal BLAST process consists of two rounds of BLAST searches; forward search and reverse search. In the forward search step, a reference polypeptide sequence, "polypeptide A," from source species SA was BLASTed against all protein sequences from a species of interest. Top hits were determined using an E-value cutoff of $10^{-5}$ and a sequence identity cutoff of 35%. Among the top hits, the sequence having the lowest E-value was designated as the best hit, and considered a potential functional homolog or ortholog. Any other top hit that had a sequence identity of 80% or greater to the best hit or to the original reference polypeptide was considered a potential functional homolog or ortholog as well. This process was repeated for all species of interest.

In the reverse search round, the top hits identified in the forward search from all species were BLASTed against all protein sequences from the source species SA. A top hit from the forward search that returned a polypeptide from the aforementioned cluster as its best hit was also considered as a potential functional homolog.

Functional homologs were identified by manual inspection of potential functional homolog sequences. Representative functional homologs for SEQ ID NO:442, SEQ ID NO:489, SEQ ID NO:568, SEQ ID NO:590, SEQ ID NO:705, SEQ ID NO:711, SEQ ID NO:742, SEQ ID NO:1012, SEQ ID NO:1129, SEQ ID NO:60, SEQ ID NO:364, SEQ ID NO:311, SEQ ID NO:160, SEQ ID NO:2, and SEQ ID NO:749 are shown in FIGS. 1-15, respectively.

Example 22—Determination of Functional Homologs by Hidden Markov Models

Hidden Markov Models (HMMs) were generated by the program HMMER 2.3.2. To generate each HMM, the default HMMER 2.3.2 program parameters, configured for global alignments, were used.

An HMM was generated using the sequences shown in FIG. 1 as input. These sequences were fitted to the model and a representative HMM bit score for each sequence is shown in the Sequence Listing. Additional sequences were fitted to the model, and representative HMM bit scores for any such additional sequences are shown in the Sequence Listing. The results indicate that these additional sequences are functional homologs of SEQ ID NO:442.

The procedure above was repeated and an HMM was generated for each group of sequences shown in FIGS. 2-15 using the sequences shown in each Figure as input for that HMM. A representative bit score for each sequence is shown in the Sequence Listing. Additional sequences were fitted to certain HMMs, and representative HMM bit scores for such additional sequences are shown in the Sequence Listing. The results indicate that these additional sequences are functional homologs of the sequences used to generate that HMM.

Other Embodiments

It is to be understood that while the invention has been described in conjunction with the detailed description thereof, the foregoing description is intended to illustrate and not limit the scope of the invention, which is defined by the scope of the appended claims. Other aspects, advantages, and modifications are within the scope of the following claims.

SEQUENCE LISTING (1364 sequences)

SEQ ID NO: 1 - DNA, 947 bp, Arabidopsis thaliana
  misc_feature: Ceres CLONE ID no.14572
  misc_feature: Encodes the peptide sequence at SEQ ID NO. 2
aaaaaaggaaagacgcaatcttttcttgtctcttccattgcttcaaatcctcctaataaagctttcctctttcactttctaatctctttaatccgtttaaatccaatcccaaatacagattttgattacaaaaatctaacattttgctgatttgtgttttagggttctctcgtgttttttatgattttgattcccgtaaagattcaatcacttttctcatatctcttgttactgaatttgatccaatcgatcgataaaccaaacccagaagctatgagagtgcacccaattcccagaaacatcaacaacacattgatccatcatcatcatcataacccgacccgagaacccggaaagaatctccgacgattaccacatatcttcaaccgtgttctggagctaccattgaggtcagaagcagatgtagcagtggaagagagacacgactgttttcgatttgtggcggagacggtaggtctctgtaacggcgatggagaaatgagggcttatatggttgagattcatcctggtataaccaagatcgttgtgaggacaaatgggtcttcttctcttggtttgtctttagacgaattagagcttgacgtgtggcgttttaggttaccggaatcaactaggcctgagcttgttactgttgctagtgttgatggtgatttgattgttactgtgcctaagaatgctgaagaagaagatgatgatggtggtggtggtgattttggacaaggtattggtagtggaaggcttgtgcttgttcagtgaatcaaagtaatgtcctctatgtaacatgagaagaagactaatctctaatcttcttcgtttcgttgatattgtgtagccttctgtttttgttgttggcaataaaagaaaagattgaatctttgatgttctcttattttgtaagatcaacaagggttgtttaaggttgtacc

SEQ ID NO: 2 - protein, 198 aa, Arabidopsis thaliana
  misc_feature: Ceres CLONE ID no.14572
  misc_feature: Bit score of 387.9 for HMM based on sequences of FIGURE 14.
MILIPVKIQSLFSYLLLLNLIQSIDKPNPEAMRVHPIPRNINNTLIHHHHHNPTREPGKNLRRLPHIFNRVLELPLRSEADVAVEERHDCFRFVAETVGLCNGDGEMRAYMVEIHPGITKIVVRTNGSSSLGLSLDELELDVWRFRLPESTRPELVTVASVDGDLIVTVPKNAEEEDDDGGGGDFGQGIGSGRLVLVQ

SEQ ID NO: 3 - protein, 198 aa, Arabidopsis thaliana
  misc_feature: Public GI ID no.18403425
  misc_feature: Bit score of 389.8 for HMM based on sequences of FIGURE 14.
  misc_feature: Functional Homolog Of Ceres CLONE ID no. 14572 at SEQ ID NO. 2
MILIPVKIQSLFSYLLLLNLIQSIDKPNPEAMRVHPIPRNINNTLIHHHHHNPTREPGKNLRRLPHIFNRVLELPLRSEADVAVEERHDCFRFVAETVGLCNGDGEMRAYMVEIHPGITKIVVRTNGSSSLGLSLDELELDVWRFRLPESTRPELVTVACVDGDLIVTVPKNAEEEDDDGGGGDFGQGIGSGRLVLVQ

SEQ ID NO: 4 - protein, 167 aa, Arabidopsis thaliana
  misc_feature: Public GI ID no.11994285
  misc_feature: Bit score of 389.8 for HMM based on sequences of FIGURE 14.
  misc_feature: Functional Homolog Of Ceres CLONE ID no. 14572 at SEQ ID NO. 2
MRVHPIPRNINNTLIHHHHHNPTREPGKNLRRLPHIFNRVLELPLRSEADVAVEERHDCFRFVAETVGLCNGDGEMRAYMVEIHPGITKIVVRTNGSSSLGLSLDELELDVWRFRLPESTRPELVTVACVDGDLIVTVPKNAEEEDDDGGGGDFGQGIGSGRLVLVQ

SEQ ID NO: 5 - protein, 171 aa, Oryza sativa subsp. japonica
  misc_feature: Public GI ID no.115470807
  misc_feature: Bit score of 370.0 for HMM based on sequences of FIGURE 14.
  misc_feature: Functional Homolog Of Ceres CLONE ID no. 14572 at SEQ ID NO. 2
MRVHPAPRKRTIAVQRRCGVAAAAAGMAGGKKLRRLPHIFAKVLELPFAADADVSVEEDAAALRFVAAADGFTPSGGASAHAVEIHPGVTKVVVRDLSAGLDGDDGAVFELDRWRFRLPPCTLPAMATATYADGELVVTVPKGAAPDDDGDGAAAAVLGGSGVVESVLLLV

SEQ ID NO: 6 - protein, 162 aa, Oryza sativa subsp. japonica
  misc_feature: Public GI ID no.108706298
  misc_feature: Bit score of 298.4 for HMM based on sequences of FIGURE 14.
  misc_feature: Functional Homolog Of Ceres CLONE ID no. 14572 at SEQ ID NO. 2
MRIHPSPATTAGGSCGGKKDLRRLPHVYSKVLELPFPADTDVAVFEGPDAFHFVVSAAAALAGEVRVRTVRIHPGVVRVVVQAGGGGVHDDGDDDDMELDKWRSRLPEASCPAMAVAGYVNGQLVVTVPKGRGGGEGDNDGGEEAWRCCNGGKISGRLVVVQ

SEQ ID NO: 7 - protein, 152 aa, Arabidopsis thaliana
  misc_feature: Public GI ID no.15233585
  misc_feature: Bit score of 291.5 for HMM based on sequences of FIGURE 14.
  misc_feature: Functional Homolog Of Ceres CLONE ID no. 14572 at SEQ ID NO. 2
MKIHPLPRNENNNNLIHHARDPTREPGKKLRRLPHIFSRVLELPLKSDADVAVEESHDCFRFVAETDGGGGGGVRAYMVEIHPGVTKILVRTNGSSSLGLSLDELELDVWRFRLPESTRPELVTVDCDGDGELIVTVPKIEDNGRDLIVLVQ

SEQ ID NO: 8 - protein, 145 aa, Oryza sativa subsp. japonica
  misc_feature: Public GI ID no.125599279
  misc_feature: Bit score of 289.0 for HMM based on sequences of FIGURE 14.
  misc_feature: Functional Homolog Of Ceres CLONE ID no. 14572 at SEQ ID NO. 2
MAGGKKLRRLPHIFAKVLELPFAADADVSVEEDAAALRFVAAADGFTPSGGASAHAVEIHPGVTKVVVRDLSAGLDGDDGAVFELDRWRFRLPPCTLPAMATATYADGELVVTVPKGAAPDDDGDGAAAAVLGGSGVVESVLLLV

SEQ ID NO: 9 - protein, 160 aa, Oryza sativa subsp. japonica
  misc_feature: Public GI ID no.115450865
  misc_feature: Bit score of 237.7 for HMM based on sequences of FIGURE 14.
  misc_feature: Functional Homolog Of Ceres CLONE ID no. 14572 at SEQ ID NO. 2
MRIHPSPATTAGGSCGGKKDLRRLPHVYSKVLELPFPADTDVAVFEGPDAFHFVVSAAAALAGEVRVRTVRIHPGVVRVVVQAGGGGVHDDGDDDDMELDKWRSRLPEASCPAMAVAGYVNGQLVVTVPKGRGGGEVQGRAVSYAVFQTAFLEAKGRKLL

SEQ ID NO: 10 - protein, 176 aa, Oryza sativa subsp. japonica
  misc_feature: Public GI ID no.22773244
  misc_feature: Bit score of 242.8 for HMM based on sequences of FIGURE 14.
  misc_feature: Functional Homolog Of Ceres CLONE ID no. 14572 at SEQ ID NO. 2
MRIHPSPATTAGGSCGGKKDLRRLPHVYSKVLELPFPADTDVAVFEGPDAFHFVVSAAAALAGEVRVRTVRIHPGVVRVVVQAGGGGVHDDGDDDDMELDKWRSRLPEASCPAMAVAGYVNGQLVVTVPKGRGGGEVQGRAVSYAVFQTAFLEAKGRKLLNTENVFPTSADIEGID

SEQ ID NO: 11 - protein, 230 aa, Medicago truncatula
  misc_feature: Public GI ID no.92874749
  misc_feature: Bit score of 220.1 for HMM based on sequences of FIGURE 14.
  misc_feature: Functional Homolog Of Ceres CLONE ID no. 14572 at SEQ ID NO. 2
MDSFEAMRCNRKWNISIAYNMMNPLSQAETLLSMSGFSNNNNKLRRLPHVFSRILQLPLRSDADVSIEEEPTCFRFVAETDSSLGHVETHTLHIHPGVTKIVVRASHSLHFSLDDLHPDIWRFRLPESVVPELATAVFVDGELIVTVPKAFDDENTPEPIGGGGATLIYLARIKPLIGHWIMRGLMIIAFDRQLNTHVLTQNLPCFRVGYDTCRIEIGLLNLRTPLWLRY

SEQ ID NO: 12 - DNA, 1154 bp, Gossypium hirsutum
  misc_feature: Ceres CLONE ID no.1857034
  misc_feature: Encodes the peptide sequence at SEQ ID NO 13
tttgtttcatattcttggggaaaaaaaaccaaatcacaaaatctaattgcccctttcagcactcaatctccaagaacaattttttttttagaatcattttcttccattttagtttttatgtaagcctttttatgggtttttatcaagatcttcccaaaaaagcaagagaaaaaaaataaaaatttgaagaattgacaccattgctttttatgattctaccttttccactcaaaaacttgatcagggttttgattcctttccaaatctcttcacttttcttcaagaaagcatctttgttgttgttgctattaataatcttgttcctcgccttcttctcctttgatttcagttcttcaaatctttgtaaaaaaaaccagaaggaacccaaatatttaataccctcaaagagcaccatgaggatccatccgttgccgaagaaaagaaacatcaccgtccaatacgagatgaacccaaggaccacaaggtctcaagctgagaccttgttgaccggcgggtccaacaagaagctccggaggttaccccacatcttcagccgcgtcctcgagctgccttttaggtcggatgcagacgtggcggtggaggaaagccctgactgtttcaagttcgtggcggagacggatgggatgatcggcgatgtcgtgagggctcatacagttgaaatccatcctggggttactaagattgtgattaggtcgaacagtttggtggattttggtttgctggatgatttggagcttgatatgtggcggttcaggctgccggagacgacacggccggagctggcgagtgctgtttacgaggatggggagctaattgtgacggtgcccaagggaggtgaagtggagaatttggaggacggtggtggtggtgacgagttgagaggaggcatgggaaatggtaataacaacaataataacaataataggcttgttcttgtacagtaagtaataaatatggaacctttagctctgtttccttaattgcatgttattttcattttagttcttgaaggtcactggtggagcttagccctttttcttttttttctttttttgtatggttactaccttttattacttaatcaaatcaagaattgttcttctctgaatgacgaaaaaaaaaaaaaaaaaaaa

SEQ ID NO: 13 - protein, 251 aa, Gossypium hirsutum
  misc_feature: Ceres CLONE ID no.1857034
  misc_feature: Bit score of 450.8 for HMM based on sequences of FIGURE 14.
  misc_feature: Functional Homolog Of Ceres CLONE ID no. 14572 at SEQ ID NO. 2
MILPFPLKNLIRVLIPFQISSLFFKKASLLLLLLIILFLAFFSFDFSSSNLCKKNQKEPKYLIPSKSTMRIHPLPKKRNITVQYEMNPRTTRSQAETLLTGGSNKKLRRLPHIFSRVLELPFRSDADVAVEESPDCFKFVAETDGMIGDVVRAHTVEIHPGVTKIVIRSNSLVDFGLLDDLELDMWRFRLPETTRPELASAVYEDGELIVTVPKGGEVENLEDGGGGDELRGGMGNGNNNNNNNNRLVLVQ

SEQ ID NO: 14 - DNA, 1210 bp, Gossypium hirsutum
  misc_feature: Ceres CLONE ID no.1842931
  misc_feature: Encodes the peptide sequence at SEQ ID NO 15
attggctcttagttttcctgcacttgaataaaaggccagatttctgtgtttctcatacaattttgtttcatattcttggaaaaaaaaaccaaatcacaaaatctaattgcctctttcagccctcaatctacaagaacaattttttttaaaaatttttagaatccttttcttccattttagtttttatgtaaccctttttatgggtttttatcaagatcttcccaaaaaagcaagagaaaaaaaataaaaatttgaagaattgacaccattgctttttatgattctaccttttccactcacaaacttgatcagggttttgattcctttccaaatctcttcacttttcttcaagaaagcatcttagttgttgttgctattaataatcttgttcctagccttcttctcctttgatttaagttcttcaaatctttgtaaaaaaaaccggaaggaacccaaatatttaataccctcaaagagcaccatgaggatccatccgttgccgaagaaaaggaacatcaccatccaatacgagatgaacccaaggaccacaaggtctcaagctgagaccttgttgatcggcgggtccaacaagaagctccggaggttaccccacatcttcagccgcgtcctcgagctgccttttaggtcggatgcagacgtggcggtggaggaaagccctgactgtttcaagttcgtggcggagacggatgggaggatcggcgatgtcgtgagggctcatacggttgaaatccatcctggggttactaagattgtgattaggtcgaacagtttggtggattttggtttgctggatgatttggagcttgatatgtggcggttcaggctgccggagacgacacggccggagctggcgagtgctgtttacgaggatggggagctaattgtgacggtgcccaagggaggtgaagtggagaatttggaggacggtggtggtggtgacgagttgagaggaggcatgggaaatggtaataacaacaataataacaataataggcttgttcttgtacagtaagtaataaatatggaacctttagctctgtttccttaattgcatgttattttcattttagttcttgaaggtcactggtggagcttagcccttctttttttttttttttgtatggttactaccttttattacttaatcaaatcaagaattgttcttctctaaaaaaaaaaaaaaaaaaaa

SEQ ID NO: 15 - protein, 183 aa, Gossypium hirsutum
  misc_feature: Ceres CLONE ID no.1842931
  misc_feature: Bit score of 450.8 for HMM based on sequences of FIGURE 14.
  misc_feature: Functional Homolog Of Ceres CLONE ID no. 14572 at SEQ ID NO. 2
MRIHPLPKKRNITIQYEMNPRTTRSQAETLLIGGSNKKLRRLPHIFSRVLELPFRSDADVAVEESPDCFKFVAETDGRIGDVVRAHTVEIHPGVTKIVIRSNSLVDFGLLDDLELDMWRFRLPETTRPELASAVYEDGELIVTVPKGGEVENLEDGGGGDELRGGMGNGNNNNNNNNRLVLVQ

SEQ ID NO: 16 - DNA, 713 bp, Zea mays
  misc_feature: Ceres CLONE ID no.321308
  misc_feature: Encodes the peptide sequence at SEQ ID NO 17
aagagaggagccttcgcttttggacttgcaccgtcgtgatctgtcccgcgaccacatgaggatccacccagcatcccccaccgccggcggcaagaaggacctccggcgcctgccgcacgtgtacagcaaggtgctggagctgccgctcccggcggacaccgacgtccaggtgttcgaaggcccagacgccttccacttcgtcgcggcgccggccgccggtgcgcgtgccgccgccaccgtgcgtgtgcgcaccgtcaggatccaccccggggtcaccaaggtcgtggtgcaggccggagccgccgaacgggccgctgacgacgacgccgccagcgacagcatggagctcgacaggtggcggtcccggctgcccgagccgacctgtccggccatggcggtggccgggtacgtcgacggccagctcgtcgtcacggtgcccaagggccccggtgccgaggaaggcgccgacgcagggcaaggcgaggttacctggaggtgcggcggcggaggcaagatcactggaagactcgtggttgtacagtaggagcgtctaatctatgtactactactccatagtaatgtcttgccatctttctttctttttttggtaaattaagatgggctagctgttcatcatgttgccttccccttcccygcttcgcatcagagacagtcagacaggcgatgtttcatgagctatgttctcttcctcc

SEQ ID NO: 17 - protein, 162 aa, Zea mays
  misc_feature: Ceres CLONE ID no.321308
  misc_feature: Bit score of 346.4 for HMM based on sequences of FIGURE 14.
  misc_feature: Functional Homolog Of Ceres CLONE ID no. 14572 at SEQ ID NO. 2
MRIHPASPTAGGKKDLRRLPHVYSKVLELPLPADTDVQVFEGPDAFHFVAAPAAGARAAATVRVRTVRIHPGVTKVVVQAGAAERAADDDAASDSMELDRWRSRLPEPTCPAMAVAGYVDGQLVVTVPKGPGAEEGADAGQGEVTWRCGGGGKITGRLVVVQ

SEQ ID NO: 18 - DNA, 901 bp, Musa acuminata
  misc_feature: Ceres CLONE ID no.1725811
  misc_feature: Encodes the peptide sequence at SEQ ID NO 19
atcgctcctctcaattcgaatcgatattggcttcaagatttctcattgagcccttcttccgtagatttttctgtttaatcgaacgaatcgttggcttttttctgaattcccctctcaattttcatcaaaagtagtgtttttccgccaaatttaggcaggtttttcatttcgatcgaggtttcgttgaagaatttaatctcggatcggtgtttgttgcggtttattggcctaaattttagggtagacaagggttttgcagaaggagatatgagggttcatccggtccccaagaagcggaacatcaccttccgctgcggcgtcaaccccgcggctgcagccaccgccgtgcacggccgacagaagaagctccgccgtctcccccacatcttcagcaaggtcctggagttaccctttgccgccgacgccgatgtggccgtcgaggaggacgcggacggcttccggttcgtcgcagcgaccgacgtcctctggggcgatgtccaagcccagacggtccagatacaccccggggtgacgaaggtgttcgtcagagacggtagcgacggcgacgacctcgacacggagctcgagctaaaccggtggcggttccggctgccgccgtccacccgcccggcgctcgccactgctgcttacactagcggtgagctcgtggtgaccattccgaagggggcagggcccgaggaggaagatggagaggtacaagaattctttggtggaggagggagtaacggggacttggggggccgagacattagccatctcgtaattgtacagtaaatgtttgatgatttgccttctctggtatcgttcgttgatagaactctcatattagggatctgctatgtaatttatgcaacgcttctattcatttcagtttgtagtt

SEQ ID NO: 19 - protein, 175 aa, Musa acuminata
  misc_feature: Ceres CLONE ID no.1725811
  misc_feature: Bit score of 418.2 for HMM based on sequences of FIGURE 14.
  misc_feature: Functional Homolog Of Ceres CLONE ID no. 14572 at SEQ ID NO. 2
MRVHPVPKKRNITFRCGVNPAAAATAVHGRQKKLRRLPHIFSKVLELPFAADADVAVEEDADGFRFVAATDVLWGDVQAQTVQIHPGVTKVFVRDGSDGDDLDTELELNRWRFRLPPSTRPALATAAYTSGELVVTIPKGAGPEEEDGEVQEFFGGGGSNGDLGGRDISHLVIVQ

SEQ ID NO: 20 - DNA, 1056 bp, Glycine max
  misc_feature: Ceres CLONE ID no.1357455
  misc_feature: Encodes the peptide sequence at SEQ ID NO 21
atcaatcaatttgcagcatcctaatctcgctcagattttctccagaaaagggaaaataaataaaaaaagagaataataataatatcttttgtaattcgcaaaacgtgatcgacgctggcgcaaattgaaattaggaattagggttagggttttcattatcttcgcccggaaaagaaaggggggaagaagaaagaaccgttcctttatgatcgaaaaggtgcctttggtcatcatcgcggtgttaatcttggtggtgcaatcctctgcagcgttccacggtataaacagaatcatgaaggtccaccctgttcctcgaaaacgcaacatctcaatccaatttggcggcgacgggggcaacccgatgtcggaggctcaggcgctgttggggatcgccgggaagaagctccggcgactaccgcacgtgttcagctgcgtgctggagctgcccttccgctccgacgccgacgttgcggtggaggaagcccccgactgcttccgctttgtggcggagaccgatggaatcggcgacgtgagggcgcacacggtggaaatccaccctggcgtgacgaagatcgtggtgagggacggcggctcggtggagctctcgctcgaccagctggagctcgatatgtggaggttccggttgccggaatcgactcggccggagctcgccagcgcggtgttcgtcgacggcgagctcatcgtcacggtgccgaaggggcacgaagaggagaatgatggggatggtgatagaggtatgggtggaggtagacttgtgcttgtacagtagtgatgaatgaatgaatgagtgggtgaggtaatgaatgattcttttgttaacgccttgtggcctttccaaacgtggccttgttagtatgtcggttagatttcaggttgttgttggaactagtttctctgtgaattttattgttgctattgttcagtcaggaacaaaaatgttttatctggattctggagaatggtttattcatcatggcaatggcaattatccaaaataggtgtaactgaggcgtgtttcgattttcatttcttctc

SEQ ID NO: 21 - protein, 165 aa, Glycine max
  misc_feature: Ceres CLONE ID no.1357455
  misc_feature: Bit score of 411.4 for HMM based on sequences of FIGURE 14.
  misc_feature: Functional Homolog Of Ceres CLONE ID no. 14572 at SEQ ID NO. 2
MKVHPVPRKRNISIQFGGDGGNPMSEAQALLGIAGKKLRRLPHVFSCVLELPFRSDADVAVEEAPDCFRFVAETDGIGDVRAHTVEIHPGVTKIVVRDGGSVELSLDQLELDMWRFRLPESTRPELASAVFVDGELIVTVPKGHEEENDGDGDRGMGGGRLVLVQ

SEQ ID NO: 22 - DNA, 910 bp, Brassica napus
  misc_feature: Ceres CLONE ID no.943370
  misc_feature: Encodes the peptide sequence at SEQ ID NO 23
atcttagaggtttccttctctcctcttctccactttctaattaaaatctgtatcattcaatcgcaaagattcgatctttctttcaaagaaataaacaaagattcgattcataaaaaccgaacctttaattcatctcggaggagggtttcgtaatctcttcttttatggttttgattccttggaatcgatcacagtttctattcccgagtctgatcctatcgcttctcatcattctaacaatcgagaaacccgacccggaagccatgagagtccacccaatccccagaaaccttaacaacaacaccttgatccaccaccaccaccatcgtcgtaacccgacccgagaacccggaaagaatctgcgtcgtttaccgcacatcttcagccgcgttcttgagcttccgttaaggtccgaagcagatgttgccgtggaggagaaacacgattgtttcagattcgtggcggaaacggagggtctctgcgacggcggggagatgagggcttacgtggtggatatccatccgggtataaccaagatcgttgtgaggacaaatgggttgtctttggggttgtcgctggacgagttggagctcgacatgtggcgttttaggcttccggagacgaccaggcctgagcttgttactgtggtttgtgttgatggggttttgattgttaccgtccccaagatggttccagaggaggaagatggtggttttggacaaggtatggcaagtgggaggcttgttcttgttcagtaatgctttggaacaaaaatttacagtttggttgtgtaatgatatgattatgatgtcttttaaaagatttgcttttcgtttctttcatatattgttgttagccttacttttttgttggcaatttagttgaaataaataaaaaaagacaggttgag

SEQ ID NO: 23 - protein, 164 aa, Brassica napus
  misc_feature: Ceres CLONE ID no.943370
  misc_feature: Bit score of 372.5 for HMM based on sequences of FIGURE 14.
  misc_feature: Functional Homolog Of Ceres CLONE ID no. 14572 at SEQ ID NO. 2
MRVHPIPRNLNNNTLIHHHHHRRNPTREPGKNLRRLPHIFSRVLELPLRSEADVAVEEKHDCFRFVAETEGLCDGGEMRAYVVDIHPGITKIVVRTNGLSLGLSLDELELDMWRFRLPETTRPELVTVVCVDGVLIVTVPKMVPEEEDGGFGQGMASGRLVLVQ

SEQ ID NO: 24 - DNA, 819 bp, Triticum aestivum
  misc_feature: Ceres CLONE ID no.1327712
  misc_feature: Encodes the peptide sequence at SEQ ID NO 25
atctcgcctcgtcttcctcctaaatcccccaacccacgcacagccacggagctccgcatcgacagcacgtaatttaaagcacctctggcctcttcccagcgcccgatctcctccccgcgcgcgcctaggttagtgtttggagccccctcctcccgtcgtcctcctgccgcagccgcatctgctcgccatgagggtccacccggccccgcggaagcgcaccatcgccgtgcagcgctgcgccgcggccgccctaagcgcagcgggcggcgccaagaagctgcggcgcctctcgcacatcttcgcgaaggtgctcgagctccctttcgccgccgacgccgacgtcgccgtcgaggaggacgcagcggagctccgcttcgtcgccgccacggaaggcttctccccaggcggcgcctgcgcccacgccctcgagatccaccctggcgtcaccaaggtcgtcgtacgggacctgtccaccggcatcggcgccgatgaccgcaccgctaccttcgagctcgatcggtggcggttccgtctcccgccttgcacgcgccccaccatggccacagcaacctacgccgagggcgagctcatcgtcaccgtgcccaagggtgccgttcctgacgagggcgatggcaacgctgacggagccgccatcctaggaggctccggggccgagagggtcctcgtgtttgtacagtaactttatgccgtaacaccacttttgctcacccgcatcgtttttaatatttatgttgcgagataatcatatattcatatggtaacaacagtgcagtaagaataagaaatgatgtatatggt

SEQ ID NO: 25 - protein, 170 aa, Triticum aestivum
  misc_feature: Ceres CLONE ID no.1327712
  misc_feature: Bit score of 383.8 for HMM based on sequences of FIGURE 14.
  misc_feature: Functional Homolog Of Ceres CLONE ID no. 14572 at SEQ ID NO. 2
MRVHPAPRKRTIAVQRCAAAALSAAGGAKKLRRLSHIFAKVLELPFAADADVAVEEDAAELRFVAATEGFSPGGACAHALEIHPGVTKVVVRDLSTGIGADDRTATFELDRWRFRLPPCTRPTMATATYAEGELIVTVPKGAVPDEGDGNADGAAILGGSGAERVLVFVQ

SEQ ID NO: 26 - DNA, 675 bp, Panicum virgatum
  misc_feature: Ceres CLONE ID no.1764692
  misc_feature: Encodes the peptide sequence at SEQ ID NO 27
agcgagagcagaggagacaccacgaaaggaacccgagagagggggaaaaaaacttcggttttggagctcttggcttgttgcgagcacatgaggatccacccagcagcagcagctcccgccggcggcaagaaggacctccgccggcttccgcacgtgtacagcaaggtgctcgagctgctgctcccggcggacaccgacgtcgaggtgttcgaaggccccgacgccttccacttcgtcgccgccggtgcgcgaggcgccggcgtggtgcaggtgcgcaccgtgaggatccaccccggggttaccaaggtagtggtgcaggcaggtggcgccggaggcgctgaggaggctggcgccgacgacatggagctcgacaggtggcggtcccggctgcccgaggcgagtcgtccggcgatggcggtggctgggtacgtcgacgggcagctcgttgtgacagttccaaaggggcgtgaaggcagcgaaggcgccgatgccgggcaaggtgaggttacctggagatactgcagcggaggaaagattagtggaagactggtggttgtacagtagtagtagagaatatatagtgcgttggtcgtcatctaatcaaaatctagtactatgtagtaatgtcttgccatctttgtttttttttcctgaagatgggctgtttattatgtt

SEQ ID NO: 27 - protein, 158 aa, Panicum virgatum
  misc_feature: Ceres CLONE ID no.1764692
  misc_feature: Bit score of 342.6 for HMM based on sequences of FIGURE 14.
  misc_feature: Functional Homolog Of Ceres CLONE ID no. 14572 at SEQ ID NO. 2
MRIHPAAAAPAGGKKDLRRLPHVYSKVLELLLPADTDVEVFEGPDAFHFVAAGARGAGVVQVRTVRIHPGVTKVVVQAGGAGGAEEAGADDMELDRWRSRLPEASRPAMAVAGYVDGQLVVTVPKGREGSEGADAGQGEVTWRYCSGGKISGRLVVVQ

SEQ ID NO: 28 - DNA, 666 bp, Glycine max
  misc_feature: Ceres CLONE ID no.1059300
  misc_feature: Encodes the peptide sequence at SEQ ID NO 29
aatctttttgttcttttatggttttggaatcgatctgtaatctcattctgactttgatccaatcgcttcttatctagaaacccgacccgaaaagccatgagagtccatccaattcttaacaacaacacattgatccaccaccaccaccatcatcaccataacccgacccgagaacccggaaagaatctccgtcgcttacctcacatcttcaaccgcgttctcgagcttccgctaaggtccgaagcagacgtctccgtggaagagaaacccgattgcttcagattcgtggcggagacggacggtcttcgcggcggcggaggggagatgacggcgtatatggtggagatccatccgggtattaccaagatcgtcgttaggacaaatgggttgtctttgggtttgtcgttggatgagttggagcttgatgtctggcgttttaggcttccggagacgacgaggcctgagcttgttaccgtggcttgtgttgatggggctttggttgttacggttcctaagatggtttcagaggaagatgatgatggttttggacaaggtgtgggaactgggaggctagttcttgttttgtaaaatcgagccatgtctctgctttggattaagacagcttatgtaattatatctatgaacgttttcatttgaatctttgtg

SEQ ID NO: 29 - protein, 163 aa, Glycine max
  misc_feature: Ceres CLONE ID no.1059300
  misc_feature: Bit score of 336.9 for HMM based on sequences of FIGURE 14.
  misc_feature: Functional Homolog Of Ceres CLONE ID no. 14572 at SEQ ID NO. 2
MRVHPILNNNTLIHHHHHHHHNPTREPGKNLRRLPHIFNRVLELPLRSEADVSVEEKPDCFRFVAETDGLRGGGGEMTAYMVEIHPGITKIVVRTNGLSLGLSLDELELDVWRFRLPETTRPELVTVACVDGALVVTVPKMVSEEDDDGFGQGVGTGRLVLVL

SEQ ID NO: 30 - DNA, 880 bp, Panicum virgatum
  misc_feature: Ceres CLONE ID no.1804869
  misc_feature: Encodes the peptide sequence at SEQ ID NO 31
gtgacacctcctcagcctttggcctcttgataccctataaatcccatcgtccctccgctgttcacctgtccaaataggcaaataccagcgagagcagaggagacaccacgaaaggaacccgagagaaggggtcttggcttgttgcgagcacatgaggatccacccagcagcagctcccgccggcggcaagaaggacctccgccggctgccgcacatgtacagcaaggtgctcgagctgccgctcccggcggacactgacgtcgaggtgttcgaaggccccgatgccctccacttcgttgccaccggtgcccgtggcgccggcgtggtgcaggtgcgcaccgtgaggatccaccccggggttaccaaggtagtggtgcaggcaggaggcaccggcggcggtgagaaggctggcgccgatgacatggagcttgacaggtggcggtcccggttgcccgaggcgagtcatcctgagatggcggtggccgggtacgtcgacgggaagctcgttgtgacggtgccaaagggccgtgatggcggtgaaagcgctgatgccagccaaggtgaggttacctgcagaagctgcagtggaggaaagatcagtggaagactggtggttgtacagtagtagtagagactatatagtgcggtggttgttcatctaatccactatctagtaatgtcttgccatctttgttttttttcctgaagatgggctgtttattatgttacttcccttgcctggttttagaatcagatgtttcacaagctgccttcccgctggttcttaagcgtatagaaacagctattgtaatttatcttagatttccttgaaaagttgaaaacaaatgtaaattctagacaaaaaaaaaaaaaaaaaaaa

SEQ ID NO: 31 - protein, 157 aa, Panicum virgatum
  misc_feature: Ceres CLONE ID no.1804869
  misc_feature: Bit score of 313.9 for HMM based on sequences of FIGURE 14.
  misc_feature: Functional Homolog Of Ceres CLONE ID no. 14572 at SEQ ID NO. 2
MRIHPAAAPAGGKKDLRRLPHMYSKVLELPLPADTDVEVFEGPDALHFVATGARGAGVVQVRTVRIHPGVTKVVVQAGGTGGGEKAGADDMELDRWRSRLPEASHPEMAVAGYVDGKLVVTVPKGRDGGESADASQGEVTCRSCSGGKISGRLVVVQ

SEQ ID NO: 32 - DNA, 840 bp, Zea mays
  misc_feature: Ceres CLONE ID no.378863
  misc_feature: Encodes the peptide sequence at SEQ ID NO 33
gccccaattccccaacacagcgcaagggccagacgcccagaaccagacgagcacggacggacctccgcaggccgcatccctccacgtgcacgagttccgaggcgccccttcgatccgcccggcccggccctctccaccgcgcgcgcgcgtccgtcgctagcgtttggccgtctccctcttgagccccgagtacccccacgacgcggcaaggaacctcgccatgagggtccacccggctccgcggaagcgcaccatcgccgtgcagcgctgcgccacggcggcggcggcggcggcggcgggcgcactcggcgggaagaagctgcgccgcctgccgcacatcttcgccaaggtgctggagctccccttcgcggccgacgcggacgtgtccgtcgaggaggacgcggcggcgctgcggttcgtcgccgcggccgtcgacggggtctcccccgatggcgcccgcgctcacgccgtcgagatccacccgggggtcaccaaggtcgtcgtccggggcctctcccccgccgacggcggcggcggggtcgacgacgatggggccgccgctttcgagctcgaccgctggcgcttccgcctcccgccctgcacgcgccctgccatggccacggccacctactcccagggcgagctcgtcgtcactgtccccaagggcgccggccccgacgacgcggccgctgtcctcggtggcacggagcgcgtcctcgtgcttgtatagtatatctacatgtcccgtccatgactcatctccactgctttgctgattcgcctgtttctattcctactactatactaataccaaatatttatttaaaaaaaaaaaaaaaa

SEQ ID NO: 33 - protein, 169 aa, Zea mays
  misc_feature: Ceres CLONE ID no.378863
  misc_feature: Bit score of 310.4 for HMM based on sequences of FIGURE 14.
  misc_feature: Functional Homolog Of Ceres CLONE ID no. 14572 at SEQ ID NO. 2
MRVHPAPRKRTIAVQRCATAAAAAAAGALGGKKLRRLPHIFAKVLELPFAADADVSVEEDAAALRFVAAAVDGVSPDGARAHAVEIHPGVTKVVVRGLSPADGGGGVDDDGAAAFELDRWRFRLPPCTRPAMATATYSQGELVVTVPKGAGPDDAAAVLGGTERVLVLV

SEQ ID NO: 34 - DNA, 1043 bp, Gossypium hirsutum
  misc_feature: Ceres CLONE ID no.1930271
  misc_feature: Encodes the peptide sequence at SEQ ID NO 35
tattgtgacggtgcctaagggagagcttggtggtggtgtgagaaatggtaacactaataataacaggtttgttcttgtacaataaaacaatatgtgatctttgctgtgttttaattgcatgttctttcgttgtccttgtccaagagctgtttttcatgtatggttattattcaataaaatgaagaaaaatttccttcaaaaaaaaaaaaaaaaaaaaaaaaaaaaaaaattctttaaaaaagaaaaaaaaaaaaaattgttttttttttaaaaaattgaaaccattgatattatratttcacttcyctcactgcataacttgatcaaaattttgatcccaaatccaaatttctttacttttgttcttcaccaaagcaccattttgtgttaccattaatttctttttccaaggattattgaaaaacttccctaaaccctcatatctgaaaccatgagaatccacccatcgcctaaraaaaraaacattgccatccaatatgagatggacccaagatctgaagccgagagacctcgcaagaagctcaggcggttgcctcacctcttcggccgcgttttggaactgccatttaggtcggacgccgacgtgacggtggaagaaagctccgatcgtttcaagtttgtggctgaaacggacgagaggattggcgatgtcgtgagggctcatgcgatggaaatccaccctggggttaccaggatcgtaataaggtcagaaaatttggtggatttttgttcattggatcatatagtgctcgacatgtggcgattcaggttgccggagatggcacgaccagagctggctagtgctatttacgaggatggggagcttattgtgacggtgcctaagggagagcttggtggtggtgtgagaaatggtaacactaataataacaggtttgttcttgtacaataaaacaatatgtgatctttgctgtgttttaattgcatgttctttcgttgtccttgtccaagagctgtttttcatgtatggttattattcaataaaatgaagaaaaatttccttc

SEQ ID NO: 35 - protein, 159 aa, Gossypium hirsutum
  misc_feature: Ceres CLONE ID no.1930271
  misc_feature: Bit score of 279.5 for HMM based on sequences of FIGURE 14.
  misc_feature: Functional Homolog Of Ceres CLONE ID no. 14572 at SEQ ID NO. 2
  misc_feature (8)..(8): Xaa is any aa, unknown, or other
  misc_feature (10)..(10): Xaa is any aa, unknown, or other
MRIHPSPXKXNIAIQYEMDPRSEAERPRKKLRRLPHLFGRVLELPFRSDADVTVEESSDRFKFVAETDERIGDVVRAHAMEIHPGVTRIVIRSENLVDFCSLDHIVLDMWRFRLPEMARPELASAIYEDGELIVTVPKGELGGGVRNGNTNNNRFVLVQ

SEQ ID NO: 36 - DNA, 706 bp, Panicum virgatum
  misc_feature: Ceres CLONE ID no.2034728
  misc_feature: Encodes the peptide sequence at SEQ ID NO 37
gtccaaataggcaaataccagcgagagcagaggagacaccacgaaaggaacccgagagaaggggtcttggcttgttgcgagcacatgaggatccacccagcagcagctcccgccggcggcaagaaggacctccgccggctgccgcacgtgtacagcaaggtgctcgagctgccgctcccggcggacactgacgtcgaggtgttcgaaggccccgacgccctccacttcgttgccgccgatgcccgtggcgccggcgtggtgcaggtgcgcaccgtgaggatccaccccggggttaccaaggtagtggtgcaggcaggaggcaccggcggcggtgagaaggctggcgccgatgacatggagcttgacaggtggcggtcccggttgcccgaggcgagtcatcttgcgatggcggtggccgggtacgtcgacgggaagctcgttgtgacagtgccaaagggccgtgatggcgccgccgtgatggcggtgaaggcgccgatgccagccaaggtgaggttacctggagaagctgcagtggaggaaagatcagtggaagactggtggttgtacagtagtagtagactatatagtgcggtggttgttcatctaatccactatctagtaatgtcttgccatctttgtttttttttcctgaagatgggctgtttattatgttacttcccttgcctggttttagcatcagatgttt

SEQ ID NO: 37 - protein, 207 aa, Panicum virgatum
  misc_feature: Ceres CLONE ID no.2034728
  misc_feature: Bit score of 234.6 for HMM based on sequences of FIGURE 14.
  misc_feature: Functional Homolog Of Ceres CLONE ID no. 14572 at SEQ ID NO. 2
MRIHPAAAPAGGKKDLRRLPHVYSKVLELPLPADTDVEVFEGPDALHFVAADARGAGVVQVRTVRIHPGVTKVVVQAGGTGGGEKAGADDMELDRWRSRLPEASHLAMAVAGYVDGKLVVTVPKGRDGAAVMAVKAPMPAKVRLPGEAAVEERSVEDWWLYSSSRLYSAVVVHLIHYLVMSCHLCFFFLKMGCLLCYFPCLVLASDV

SEQ ID NO: 38 - DNA, 714 bp, Panicum virgatum
  misc_feature: Ceres CLONE ID no.1866421
  misc_feature: Encodes the peptide sequence at SEQ ID NO 39
aaaggaaacaccacgaaaggaacccgaaagagggggaaaaaaacttcggttttggagctcttggcttgttgcgagcacatgaggatccacccagcagcagcagctcccgccggcggcaaaaaggacctccgccggcttccgcacgtgtacagcaaggggctcgagctgctgctcccggcggacaccgacgtcaaggggttcaaaggccccaaccccttccacttcgtcgccgccggtgcgcgaggcgccggcgtggtgcaggtgcgcaccgggaggatccaccccggggttaccaaggtagtggtgcaggcaggtggcgccggaggcgctaaggaggctggcgccaacaacatgaagctcgtcaccatcctcagcgtctgcctcaccatgtacggcgtcccctccttcaacaaggggaacccgtccacggcgcccacgctcacgctcacggggcgcaaaaaggaggccaacaagctgcaaaccgccaacgggtgggccaagttcaccgaaggcttcttcttcggcggcatctccggcgtgctctgggcatacttcctcctctacgtgctcaacctcccctactacttcaagtagacgtacgggctccatatgcaaatcccctcctctctacacatgtgggtaggtgatgtttgtgtggttcttgattgagcagtgatcgagcacgtgtataaattaatgtattactttctctgg

SEQ ID NO: 39 - protein, 171 aa, Panicum virgatum
  misc_feature: Ceres CLONE ID no.1866421
  misc_feature: Bit score of 87.7 for HMM based on sequences of FIGURE 14.
  misc_feature: Functional Homolog Of Ceres CLONE ID no. 14572 at SEQ ID NO. 2
MRIHPAAAAPAGGKKDLRRLPHVYSKGLELLLPADTDVKGFKGPNPFHFVAAGARGAGVVQVRTGRIHPGVTKVVVQAGGAGGAKEAGANNMKLVTILSVCLTMYGVPSFNKGNPSTAPTLTLTGRKKEANKLQTANGWAKFTEGFFFGGISGVLWAYFLLYVLNLPYYFK

SEQ ID NO: 40 - DNA, 516 bp, Populus balsamifera subsp. trichocarpa
  misc_feature: Ceres ANNOT ID no.1512656
  misc_feature: Encodes the peptide sequence at SEQ ID NO 41
atgaaggttcacccattacccaagaaaagaaacattaccatccaattctacccattaacatcttctgcaggtgggttccaaaacaagaaacttaggaggctaccccacatattcagccggatcttggaactccccttccggtcagatgctgatgtgtcggtcgaggaaaatcccgattgtttccgatttgtagctgaaactgatgataacattggtgatatgagggcccacacagttgaaatccaccctggagtcattaaaattgtgattaggccaaatgggtatcttgaattatcgtcacttgacgatttagagttggatatgtggagattccgtttaccggaaaccaccaggccggagcttgcgagtgcggttcttgctgacggagagttgattgtgacggtgccaaaaggagagggggaggggggggatgggaatggtaataataacaacggggagtttagaggaggtatgggaaataacaataataatgctaggcttgtgcttgtacagtga

SEQ ID NO: 41 - protein, 171 aa, Populus balsamifera subsp. trichocarpa
  misc_feature: Ceres ANNOT ID no.1512656
  misc_feature: Bit score of 416.5 for HMM based on sequences of FIGURE 14.
  misc_feature: Functional Homolog Of Ceres CLONE ID no. 14572 at SEQ ID NO. 2
MKVHPLPKKRNITIQFYPLTSSAGGFQNKKLRRLPHIFSRILELPFRSDADVSVEENPDCFRFVAETDDNIGDMRAHTVEIHPGVIKIVIRPNGYLELSSLDDLELDMWRFRLPETTRPELASAVLADGELIVTVPKGEGEGGDGNGNNNNGEFRGGMGNNNNNARLVLVQ

SEQ ID NO: 42 - DNA, 543 bp, Populus balsamifera subsp. trichocarpa
  misc_feature: Ceres ANNOT ID no.1463492
  misc_feature: Encodes the peptide sequence at SEQ ID NO 43
atgaaggtgcatccattacccaagaagagaaacaacataacaatccaattctacgatcatagaggagaccctttagtatcatcttctggtgggtcccaacacaagaaactcaggaggctaccccacatattcagccgggtcttggaactccccttccggtcagatgctgacgtgtcggttgaggaaaatcctgattgctttcgatttgttgctgaaacagataataacatcggtgaagtgagggcccacaccgttgaaatctatcctggagtaactaaaattgtgattaggccaaatgggtatctagatatatctccacttgatgatttggagttggatatgtggaggttccggttgccggaaaccaccaggccggagcttgcgagtgcggttctggctgacggagagttgattgtgacggttccgaaaggagaggaagtggaggaggaagggaatggtaataataacaatggcgagtttagaggaggtatgggaaataatagtagtaataataataatgctaggcttgtgcttgtacagtga

SEQ ID NO: 43 - protein, 180 aa, Populus balsamifera subsp. trichocarpa
  misc_feature: Ceres ANNOT ID no.1463492
  misc_feature: Bit score of 394.1 for HMM based on sequences of FIGURE 14.
  misc_feature: Functional Homolog Of Ceres CLONE ID no. 14572 at SEQ ID NO. 2
MKVHPLPKKRNNITIQFYDHRGDPLVSSSGGSQHKKLRRLPHIFSRVLELPFRSDADVSVEENPDCFRFVAETDNNIGEVRAHTVEIYPGVTKIVIRPNGYLDISPLDDLELDMWRFRLPETTRPELASAVLADGELIVTVPKGEEVEEEGNGNNNNGEFRGGMGNNSSNNNNARLVLVQ

SEQ ID NO: 44 - DNA, 561 bp, Populus balsamifera subsp. trichocarpa
  misc_feature: Ceres ANNOT ID no.1459391
  misc_feature: Encodes the peptide sequence at SEQ ID NO 45
atgaaggttcacccattacccaagaaaagaaacattaccatccaattctacccattaacatcttctgcaggtgggttccaaaacaagaaacttaggaggctaccccacatattcagccggatcttggaactccccttccggtcagatgctgatgtgtcggtcgaggaaaatcccgattgtttccgatttgtagctgaaactgatgataacattggtgatatgagggcccacacagttgaaatccaccctggagtcattaaaattgtgattaggccaaatgggtatcttgaattatcgtcacttgacgatttagagttggatatgtggagattccgtttaccggaaaccaccaggccggagcttgcgagtgcggttcttgctgacggagagttgattgtgacggtgccaaaaggagagggggaggggggggatgggaatggtaataataacaacggggagtttagaggagcgtgtgttgataacgattatggtagcagtagcattgaatatggaagtttgagactgggtagttcatcatgttttggcatgctccgatactaa

SEQ ID NO: 45 - protein, 186 aa, Populus balsamifera subsp. trichocarpa
  misc_feature: Ceres ANNOT ID no.1459391
  misc_feature: Bit score of 367.2 for HMM based on sequences of FIGURE 14.
  misc_feature: Functional Homolog Of Ceres CLONE ID no. 14572 at SEQ ID NO. 2
MKVHPLPKKRNITIQFYPLTSSAGGFQNKKLRRLPHIFSRILELPFRSDADVSVEENPDCFRFVAETDDNIGDMRAHTVEIHPGVIKIVIRPNGYLELSSLDDLELDMWRFRLPETTRPELASAVLADGELIVTVPKGEGEGGDGNGNNNNGEFRGACVDNDYGSSSIEYGSLRLGSSSCFGMLRY

SEQ ID NO: 46 - DNA, 504 bp, Populus balsamifera subsp. trichocarpa
  misc_feature: Ceres ANNOT ID no.1442920
  misc_feature: Encodes the peptide sequence at SEQ ID NO 47
atgaaggtccacccaactccaaagaagcgaagcattaccaccacccaatacaacgatgcttctcgcacccacaccccaaacgcaaagaagctaaaaagactccctcacgtatttgctagagtactggaacttccattccactcagatactgacgttttggtccaagaaactccagattctttccgtttcgtggcaaacagtgagaacataaccattcccgatgattatcaagcccgcgtagttgagatatttccagggctgacaaagatcgtggtaattaaagaaacagacagcggtgatcattatccttccatggatgaacttgaaatcgacacgtggaggtgtcggctcccggccacggtgcgcccggagatggcgagtgcaaggtgtattgaaggacagttggttgttactgttccaaagaccctgaatttggagaattttgctggtgggcaaaatgttgatgacgaagcaaatataagttggcttgatggattgctttga

SEQ ID NO: 47 - protein, 167 aa, Populus balsamifera subsp. trichocarpa
  misc_feature: Ceres ANNOT ID no.1442920
  misc_feature: Bit score of 199.8 for HMM based on sequences of FIGURE 14.
  misc_feature: Functional Homolog Of Ceres CLONE ID no. 14572 at SEQ ID NO. 2
MKVHPTPKKRSITTTQYNDASRTHTPNAKKLKRLPHVFARVLELPFHSDTDVLVQETPDSFRFVANSENITIPDDYQARVVEIFPGLTKIVVIKETDSGDHYPSMDELEIDTWRCRLPATVRPEMASARCIEGQLVVTVPKTLNLENFAGGQNVDDEANISWLDGLL

SEQ ID NO: 48 - DNA, 534 bp, Sorghum bicolor
  misc_feature: Ceres ANNOT ID no.6011447
  misc_feature: Encodes the peptide sequence at SEQ ID NO 49
atgagggtccacccggccccgcggaagcgcaccatcgcggtgcagcgctgcgccacggcggcggcggcggcgggcgcggtcggcgggaagaagctgcgccggctgccgcacatcttcgccaaggtgctggagctcccgttcgcggccgacgcggacgtgtccgtggaggaggacgccgccgcgctgcggttcgtcgccgccgccgtcgtcgacgtcgacgggttctccttctcccccgcgggtggcccccgcgcgcacgccgtcgagatccacccgggggtcaccaaggtcgtcgtccggggcctgtcctccggcgcccacgatgacgacgacgatggggcagccgccgccttcgagctcgaccgctggcggttccgcctcccgccctgcacgcgccccgccatggccaccgccacctacgcccagggcgagctcgtcgtcaccgtccccaagggcgccggccccgacgacggcgacggcgatgcggccgctgctgccctcggtggcacggaccgcgtcctcgtgcttgtatag

SEQ ID NO: 49 - protein, 177 aa, Sorghum bicolor
  misc_feature: Ceres ANNOT ID no.6011447
  misc_feature: Bit score of 324.3 for HMM based on sequences of FIGURE 14.
  misc_feature: Functional Homolog Of Ceres CLONE ID no. 14572 at SEQ ID NO. 2
MRVHPAPRKRTIAVQRCATAAAAAGAVGGKKLRRLPHIFAKVLELPFAADADVSVEEDAAALRFVAAAVVDVDGFSFSPAGGPRAHAVEIHPGVTKVVVRGLSSGAHDDDDDGAAAAFELDRWRFRLPPCTRPAMATATYAQGELVVTVPKGAGPDDGDGDAAAAALGGTDRVLVLV

SEQ ID NO: 50 - DNA, 510 bp, Sorghum bicolor
  misc_feature: Ceres ANNOT ID no.6068218
  misc_feature: Encodes the peptide sequence at SEQ ID NO 51
atgaggatccacccagcatctcccaccgtcgtcggcggcggtggcggcaagaaggacctccggcgtctgccgcacgtgtacagcaaggtgctggagctgccgctcccggcggacaccgacgtcgaggtgttcgaaggccccgacgccttccacttcgtcgcggcgccgcccgccggcggtggtgcgcgtggcgccggcgtcgtgcgggtgcgcaccgtcaggatccaccccggggtcaccaaggtcgtcgtgcaggccggcgacgccgccgagggggttgctgacgacgacgacgccggcgacagcatggagctcgacaggtggcggtcccgcctgcccgagccgagctgtccggccatggcggtggctgggtacgtcgacggccagctcgtcgtgacagtgcccaagggccccggtggcggtgaaggcggcgacggcgggcaaggtgaggttacctggaggtgcagtggcggggggaagattagtggaagactggtgcttgtacagtag

SEQ ID NO: 51 - protein, 169 aa, Sorghum bicolor
  misc_feature: Ceres ANNOT ID no.6068218
  misc_feature: Bit score of 323.4 for HMM based on sequences of FIGURE 14.
  misc_feature: Functional Homolog Of Ceres CLONE ID no. 14572 at SEQ ID NO. 2
MRIHPASPTVVGGGGGKKDLRRLPHVYSKVLELPLPADTDVEVFEGPDAFHFVAAPPAGGGARGAGVVRVRTVRIHPGVTKVVVQAGDAAEGVADDDDAGDSMELDRWRSRLPEPSCPAMAVAGYVDGQLVVTVPKGPGGGEGGDGGQGEVTWRCSGGGKISGRLVLVQ

SEQ ID NO: 52 - DNA, 771 bp, Sorghum bicolor
  misc_feature: Ceres ANNOT ID no.6044121
  misc_feature: Encodes the peptide sequence at SEQ ID NO 53
atggacccgccagggaacctcagcggcccaggaacctcaccgtcctttcaaggtggcccgtttgaagctaaaactctaaaagtgctaacttatgctgctaatggaggtcatatcatagtcagaggtcttaaggacaatgtcagtacatgtgggccatataatttgggtggttctaccacacaacggatgggtacagagttgcattatcaggccccaatttcattgtccccaaagatgaggcagaacaccaagattgtgtcaagatatgctgaatcagcgcctggtacgttgtggaggaggaaaaaaaggtcagcgggaagactgcgctggctgccgcacatcttcgccaaggtgctggagctcccgttcgcggccgacgcggacgtgtccatcgaggaggacgcggcagcgttgcagttcgtcgccgccgccgtcgtcgacgtcgacgggttctccttctcccccgcaggtggctcccgcgcgcacgccgtcaagatccacccgggggtcaccaaggtcgtcgtccggggcctgtcctttggcgccaacgacgacgacgatggggcaggcgccgccttcgagctcgaccgctggcggttccgcctccctccctgcacgcgccccgccatggccaccgccacctacgcccagggcgagctcgtcgtcaccgtccccaagggcgccggccccgacgacggcgacggcgacggcgacggcgatgcggccactgctgccctcggtggcacggaccgcgtcctcgtgcttgtatag

SEQ ID NO: 53 - protein, 256 aa, Sorghum bicolor
  misc_feature: Ceres ANNOT ID no.6044121
  misc_feature: Bit score of 241.0 for HMM based on sequences of FIGURE 14.
  misc_feature: Functional Homolog Of Ceres CLONE ID no. 14572 at SEQ ID NO. 2
MDPPGNLSGPGTSPSFQGGPFEAKTLKVLTYAANGGHIIVRGLKDNVSTCGPYNLGGSTTQRMGTELHYQAPISLSPKMRQNTKIVSRYAESAPGTLWRRKKRSAGRLRWLPHIFAKVLELPFAADADVSIEEDAAALQFVAAAVVDVDGFSFSPAGGSRAHAVKIHPGVTKVVVRGLSFGANDDDDGAGAAFELDRWRFRLPPCTRPAMATATYAQGELVVTVPKGAGPDDGDGDGDGDAATAALGGTDRVLVLV

SEQ ID NO: 54 - DNA, 396 bp, Sorghum bicolor
  misc_feature: Ceres ANNOT ID no.6100755
  misc_feature: Encodes the peptide sequence at SEQ ID NO 55
atggtgctggagctcccgttcgcagccgaggtggacgtgtccgtcgaggaggacgcggcagcgctgcggttcgtcgtcgacgtcaacgggttctcctcccccgcgggtggcccccgcgcgcacgccgtcgagatccacccgggggtcaccaaggtcgtcctccggggcctgtccttcggcgcccacgacgacgacgatggggcaggcgccgccttcgagctcgaccgctggcggttccgcctccctccctgcacgcgccccgccgtggccaccgccacctacgcccagggcgagctcgtcgtcaccgtccccaagggcgccggccccgacgacggcgacggcgatgcgaccgctgctgccctcggtggcacggaccgcgtcctcgtgcttgtatag

SEQ ID NO: 55 - protein, 131 aa, Sorghum bicolor
  misc_feature: Ceres ANNOT ID no.6100755
  misc_feature: Bit score of 159.0 for HMM based on sequences of FIGURE 14.
  misc_feature: Functional Homolog Of Ceres CLONE ID no. 14572 at SEQ ID NO. 2
MVLELPFAAEVDVSVEEDAAALRFVVDVNGFSSPAGGPRAHAVEIHPGVTKVVLRGLSFGAHDDDDGAGAAFELDRWRFRLPPCTRPAVATATYAQGELVVTVPKGAGPDDGDGDATAAALGGTDRVLVLV

SEQ ID NO: 56 - DNA, 546 bp, Arabidopsis thaliana
  misc_feature: Ceres CLONE ID no.263956
  misc_feature: Inplanta Sequence
  misc_feature: Encodes the peptide sequence at SEQ ID NO. 57
atcaatcaccaaaacacattcattgtcttaaaccctaaacctcaagaaccgaacaaccacaccaaaaaatgagaccggttggcttgatctttacggtcatgttcttggtctcggccttttcggaatcaagaaccgcggattgcagagttctccttggtggttcgacggaggaaatcgatcaatctaaaattcatggggtcgatttacgaagtgaagacttattaggggtcgtgatacatggttataagaagctaaggtggctctcatcggccggggagaggatgcatacaatggcttcaggaccgagcaggagaggtgctggtcactaaaatacgaacccaaacaaaacattatacttcgatatttgtttagctcaggtcatagaatcatatttttcattttttatagattattatatttattcagtcgctaaagatccatgtaaagtttagaagggtgatattctttgatcatacaatagtcggtttccttctcataaacaccaatttatagtacgtgcccattaatcgatatttattttagttt

SEQ ID NO: 57 - protein, 86 aa, Arabidopsis thaliana
  misc_feature: Ceres CLONE ID no.263956
MRPVGLIFTVMFLVSAFSESRTADCRVLLGGSTEEIDQSKIHGVDLRSEDLLGVVIHGYKKLRWLSSAGERMHTMASGPSRRGAGH

SEQ ID NO: 58 - DNA, 839 bp, Arabidopsis thaliana
  misc_feature: Ceres CLONE ID no.31309
  misc_feature: Expected Sequence
  misc_feature: Encodes the peptide sequence at SEQ ID NO. 60
atataagtctttctcactccttctctttcctttgtgattcatatccttcttcttctccaagaacctctctctctttctgcttctctatattttaacactttcttccgaatttgcccctcaagttttattttaattgctaaaatggctggaaccctagttaactccgccgggagattctcaccgggaaattgtattcttcctcaacagagaacagccagattctacagcggaaccgcgagatttcccaccggagctccttcgtttaaggctttcagctcagacgcttaacgccgagccagctgtaacggaatccgttcgtcggagagtttctagcctctacgaattactgaaagtgaatgaaacggcgtccttgacggagatcaagacggcgtaccggagcttagctaaagtatatcatccagatgcgtcggaatcggacggtcgagatttcatggagattcacaaagttacgcgacacttgcggatccgactacaagagcgatttacgactcgacgcttagagtaccacggagacgggtacacgccggagcgatgggtcggtcggggcgggtttacgctacgacccggagatgggagacggatcagtgttggtgattttaggcttcctatgattttgcagcagcgaaagggcactttttgacttactttcccctttgattacgttttttttttccttgtcatatctttggaaaattaaggggaaattaagtttaatccgctctttttttttttttttgtttttcttttaacttaagcagttaacaatgtataaagaagttatgagtagagaaatgtatatgattttagttttctccttt

SEQ ID NO: 59 - DNA, 838 bp, Arabidopsis thaliana
  misc_feature: Ceres CLONE ID no.31309
  misc_feature: Inplanta Sequence
  misc_feature: Encodes the peptide sequence at SEQ ID NO. 60
atataagtctttctcactccttctctttcctttgtgattcatatccttcttcttctccaagaacctctctctctttctgcttctctatattttaacactttcttccgaatttgcccctcaagttttattttaattgctaaaatggctggaaccctagttaactccgccgggagattctcaccgggaaattgtattcttcctcaacagagaacagccagattctacagcggaaccgcgagatttcccaccggagctccttcgtttaaggcttcagctcagacgcttaacgccgagccagctgtaacggaatccgttcgtcggagagtttctagcctctacgaattactgaaagtgaatgaaacggcgtccttgacggagatcaagacggcgtaccggagcttagctaaagtatatcatccagatgcgtcggaatcggacggtcgagatttcatggagattcacaaagcttacgcgacacttgcggatccgactacaagagcgatttacgactcgacgcttagagtaccacggagacgggtacacgccggagcgatgggtcggtcggggcgggtttacgctacgacccggagatgggagacggatcagtgttggtgattttaggcttcctatgattttgcagcagcgaaagggcactttttgacttactttcccctttgattacgttttttttttccttgtcatatctttggaaaattaaggggaaattaagtttaatccgctcttttttttttttttttttttttttaacttaaagcgttaaaaattgttaaaaaaatttttaattaaaaaattttttttttttttttttttccctttt

SEQ ID NO: 60 - protein, 157 aa, Arabidopsis thaliana
  misc_feature: Ceres CLONE ID no.31309
  misc_feature: Bit score of 386.5 for HMM based on sequences of FIGURE 10.
  misc_feature (64)..(123): Pfam Name: DnaJ Pfam Description: DnaJ domain
MAGTLVNSAGRFSPGNCILPQQRTARFYSGTARFPTGAPSFKASAQTLNAEPAVTESVRRRVSSLYELLKVNETASLTEIKTAYRSLAKVYHPDASESDGRDFMEIHKAYATLADPTTRAIYDSTLRVPRRRVHAGAMGRSGRVYATTRRWETDQCW

SEQ ID NO: 61 - DNA, 750 bp, Brassica napus
  misc_feature: Ceres CLONE ID no.872030
  misc_feature: Encodes the peptide sequence at SEQ ID NO 62
ctcttattactgatacttatcttctgcttctcagaggaactctctctgcttaatccaatcttaacgcgttctttcgaatttgcccctccaattttaatttaattacgtaaatgtccggaactctaatctactctgccgttaactcccttcgatcctcgccgggaaatagccttcgtcaaccgaagccaaccagactccacaacggaaacgcgcggtttcccaccggagctacgtcgtttagagcttcggcagcgcagactctcaacgccgagccagccgtaacggaatccgttcgccggcgagcgtcgagcctctacgaactgctgagagtcgacgaaacggcgtcgttgacggagattaagacggcgtatcggagcttagctaaggttcaccatcctgatgcgtcgtcggaatcggacggacgagatttcatggagatccacaaagcttacgcgacgctggcggatccgacgaccagagcgatctacgattcgacgctgggagcacgagggagacgaatgcacgctggagctacgggtcggacgagtcgggtttacccgacgacccggagatgggagacggatcagtgttggtagtttagtctttaggtttccgttacttttttttactctatttccccctttcattattttttaactaaggggtaaataagtttttactagcctttttttttttaacttaaagaaggtaacaatgtgtcacagatggttaatgaatagagagatgtac

SEQ ID NO: 62 - protein, 161 aa, Brassica napus
  misc_feature: Ceres CLONE ID no.872030
  misc_feature: Bit score of 389.8 for HMM based on sequences of FIGURE 10.
  misc_feature (67)..(127): Pfam Name: DnaJ Pfam Description: DnaJ domain
  misc_feature: Functional Homolog Of Ceres CLONE ID no. 31309 at SEQ ID NO. 60
MSGTLIYSAVNSLRSSPGNSLRQPKPTRLHNGNARFPTGATSFRASAAQTLNAEPAVTESVRRRASSLYELLRVDETASLTEIKTAYRSLAKVHHPDASSESDGRDFMEIHKAYATLADPTTRAIYDSTLGARGRRMHAGATGRTSRVYPTTRRWETDQCW

SEQ ID NO: 63 - protein, 369 aa, Arabidopsis thaliana
  misc_feature: Public GI ID no.18399940
  misc_feature: Bit score of 670.7 for HMM based on sequences of FIGURE 9.
  misc_feature (116)..(349): Pfam Name: Trehalose_PPase Pfam Description: Trehalose-phosphatase
  misc_feature: Functional Homolog Of Ceres SEEDLINE ID no. ME20095 at SEQ ID NO. 1129
MTNHNALISDAKGSIGVAVRVPNQSLFSPGGGRYISIPRKKLVQKLEADPSQTRIHTWIEAMRASSPTRTRPGNISPLPESDEEDEYSSWMAQHPSALTMFEEIAEASKGKQIVMFLDYDGTLSPIVENPDRAYMSEEMREAVKGVARYFPTAIVTGRCRDKVRRFVKLPGLYYAGSHGMDIKGPSKRNKHNKNNKGVLFQAANEFLPMIDKVSKCLVEKMRDIEGANVENNKFCVSVHYRCVDQKDWGLVAEHVTSILSEYPKLRLTQGRKVLEIRPTIKWDKGKALEFLLESLGFANSNDVLPIYIGDDRTDEDAFKVLRNKGQGFGILVSKIPKETSATYSLQEPSEVGEFLQRLVEWKQMSLRGR

SEQ ID NO: 64 - protein, 160 aa, Arabidopsis thaliana
  misc_feature: Public GI ID no.15227919
  misc_feature: Bit score of 174.9 for HMM based on sequences of FIGURE 10.
  misc_feature (68)..(132): Pfam Name: DnaJ Pfam Description: DnaJ domain
  misc_feature: Functional Homolog Of Ceres CLONE ID no. 31309 at SEQ ID NO. 60
MLSSSPTFFATPFLSSSSSSSPSFSSTSPPSRISRISPSLSTTTASYTCAEDLPRLRQIPQRFSATASLYEILEIPVGSTSQEIKSAYRRLARICHPDVARNSRDNSSADDFMKIHAAYCTLSDPEKRAVYDRRTLLRSRPLTAGYGSYGGRNWETDQCW

SEQ ID NO: 65 - protein, 161 aa, Arabidopsis thaliana
  misc_feature: Public GI ID no.9843641
  misc_feature: Bit score of 165.4 for HMM based on sequences of FIGURE 10.
  misc_feature (65)..(130): Pfam Name: DnaJ Pfam Description: DnaJ domain
  misc_feature: Functional Homolog Of Ceres CLONE ID no. 31309 at SEQ ID NO. 60
MLSSSPTSFTHPFLSSSPPLSPISPPSRTARISPPLVSASCSYTYTEDSPRLHQIPRRLTTVPASLYDVLEVPLGATSQDIKSAYRRLARICHPDVAGTDRTSSSSADEFMKIHAAYCTLSDPEKRSVYDRRMLRRSRPLTVGTSGLGRYVGRNWETDQCW

SEQ ID NO: 66 - protein, 155 aa, Solanum lycopersicum
  misc_feature: Public GI ID no.124294789
  misc_feature: Bit score of 162.2 for HMM based on sequences of FIGURE 10.
  misc_feature (61)..(120): Pfam Name: DnaJ Pfam Description: DnaJ domain
  misc_feature: Functional Homolog Of Ceres CLONE ID no. 31309 at SEQ ID NO. 60
MASSSFLLSTSITGSKLSAAAPPRSSVSFKQRPFSVSAAYSTAERTSTATTSSSTIASHTSLYEVLGIRFGANSHEIKSAYRKLARILHPDVRNSSAEDFIRVQSAYATLSDPEKRANYDRNLFGNRIARPVDFSTAGARSHYTVRRGWETDQCW

SEQ ID NO: 67 - protein, 161 aa, Arabidopsis thaliana
  misc_feature: Public GI ID no.15233446
  misc_feature: Bit score of 162.1 for HMM based on sequences of FIGURE 10.
  misc_feature (65)..(130): Pfam Name: DnaJ Pfam Description: DnaJ domain
  misc_feature: Functional Homolog Of Ceres CLONE ID no. 31309 at SEQ ID NO. 60
MLSSSPTSFTHPFLSSSPPLSPISPPSRTARISPPLVSASCSYTYTEDSPRLHQIPRRLTTVPASLYDVLEVPLGATSQDIKSAYRRLARICHPDVAGTDRTSSSSADEFMKIHAAYCTLSDPEKRSVYDRRMLRRSRPLTVGTSGLGSYVGRNWETDQCW

SEQ ID NO: 68 - protein, 198 aa, Oryza sativa subsp. japonica
  misc_feature: Public GI ID no.115477679
  misc_feature: Bit score of 113.2 for HMM based on sequences of FIGURE 10.
  misc_feature (96)..(156): Pfam Name: DnaJ Pfam Description: DnaJ domain
  misc_feature: Functional Homolog Of Ceres CLONE ID no. 31309 at SEQ ID NO. 60
MWVRERRSRASNMRERSSSAGPHRDANNPWCRSPILRDRSASCPPFLSSFLLMISAPSVGIAFAPKPPPAAAVGSYRARKVRCAVAVAPAPAPAGTLYDVLGLRAGATVREIKAAYRRLARERHPDVAASAGADDFVRLHDAYATLSDPDSRARYDRDVVAVASMARGAHHRTMAAPAAAPRWYGRRPRRTWETDQCW

SEQ ID NO: 69 - protein, 146 aa, Oryza sativa subsp. japonica
  misc_feature: Public GI ID no.42407552
  misc_feature: Bit score of 106.0 for HMM based on sequences of FIGURE 10.
  misc_feature (44)..(104): Pfam Name: DnaJ Pfam Description: DnaJ domain
  misc_feature: Functional Homolog Of Ceres CLONE ID no. 31309 at SEQ ID NO. 60
MISAPSVGIAFAPKPPPAAAVGSYRARKVRCAVAVAPAPAPAGTLYDVLGLRAGATVREIKAAYRRLARERHPDVAASAGADDFVRLHDAYATLSDPDSRARYDRDVVAVASMARGAHHRTMAAPAAAPRWYGRRPRRTWETDQCW

SEQ ID NO: 70 - protein, 146 aa, Oryza sativa subsp. indica
  misc_feature: Public GI ID no.125562450
  misc_feature: Bit score of 105.7 for HMM based on sequences of FIGURE 10.
  misc_feature (44)..(104): Pfam Name: DnaJ Pfam Description: DnaJ domain
  misc_feature: Functional Homolog Of Ceres CLONE ID no. 31309 at SEQ ID NO. 60
MISAPSVGIAFAPKPPPAAAVGSYRARKVRCAVAVAPAPAPAGTLYDVLGLRAGATVREIKAAYRRLARERHPDVAASAGADDFVRLHDAYATLSDPDSRARYDRDVVAIASMARGAHHRTMAAPAAAPRWYGRRPRRTWETDQCW

SEQ ID NO: 71 - protein, 133 aa, Oryza sativa subsp. japonica
  misc_feature: Public GI ID no.115469980
  misc_feature: Bit score of 96.6 for HMM based on sequences of FIGURE 10.
  misc_feature (44)..(103): Pfam Name: DnaJ Pfam Description: DnaJ domain
  misc_feature: Functional Homolog Of Ceres CLONE ID no. 31309 at SEQ ID NO. 60
MASFASTAAPWGCVAGARRGGGGGGRCGVRASAALAVAAPAARTHYEVLGVGAGASRGEIKAAYRRLAREVHPDAGATGDEDFIRLHAAYATLADPDERARYDRAMAGPAASAFRRAPASSFRRRTWETDQCW

SEQ ID NO: 72 - DNA, 1149 bp, Sorghum bicolor
  misc_feature: Ceres ANNOT ID no.6107929
  misc_feature: Encodes the peptide sequence at SEQ ID NO 73
atggatttgaagacaggcctcaattcacctgttattgctgaccatctccctacgttagcatcacctgctgctgtcatgactttcacaacacctactagctttccctctccggggctttgcttgaacactacaaagaagatacctctacctggtaagattgaagaagttcgtgctactggatggcttgacctcatgaaggcctcatcacctacccgcaaaaggcagaccaaggatgccatctgtgatactcaatctgatgatcttgatttgcaataccgcaactggacggtgaactatccttctgctttgacctcatttgaggaaattagtgatcttgctgggaataaaagattggcattgtttcttgattatgatggaacactttcaccgattgtggacaatcctgaaaatgcattaatgtctgatgagatgcgtgctgcagtgaggcatgtggcatcacttttcccaactgcaatcattagcggaaggtctcgtgataaggtttttgactttgtcaacctaaatgaactatactacgctggaagccatggaatggacataatgggccctgttaggaagactactgactccaatggcgtggaatgtattcggtcaactgatgcgcatggtaaagaagtcaatctgttccaacctgctagtgagtttttacctatgatcactgaggtgtatgaaaaacttggtgagagtgttaaggacattgatggtgcaaggatggaagacaacaagttctgtgtgtctgtgcattaccgtaatgtggcggaagatgactataaaaaggttttccatcgtgtaagtgctgttttggaagattacccttgcctaagactaacccatgggagaaaggtttttgaggtccgtcctgttattgattggaacaaaggtaaagctgtggagtttttactcgaatcacttgggctcaacgagagtgaagatgttctccctatctatgttggagatgacagaacagatgaagatgcattcaaagttctgaaggcaagcaaccgtggctttggaatattggtgtcatctatacccaaagagagtgacgccttctattccttgagggatccagctgaggtgatggaatttctgagaatgttggcagcatggaaggagcagtccacctga

SEQ ID NO: 73 - protein, 382 aa, Sorghum bicolor
  misc_feature: Ceres ANNOT ID no.6107929
  misc_feature: Bit score of 823.3 for HMM based on sequences of FIGURE 9.
  misc_feature (121)..(365): Pfam Name: Trehalose_PPase Pfam Description: Trehalose-phosphatase
  misc_feature: Functional Homolog Of Ceres SEEDLINE ID no. ME20095 at SEQ ID NO. 1129
MDLKTGLNSPVIADHLPTLASPAAVMTFTTPTSFPSPGLCLNTTKKIPLPGKIEEVRATGWLDLMKASSPTRKRQTKDAICDTQSDDLDLQYRNWTVNYPSALTSFEEISDLAGNKRLALFLDYDGTLSPIVDNPENALMSDEMRAAVRHVASLFPTAIISGRSRDKVFDFVNLNELYYAGSHGMDIMGPVRKTTDSNGVECIRSTDAHGKEVNLFQPASEFLPMITEVYEKLGESVKDIDGARMEDNKFCVSVHYRNVAEDDYKKVFHRVSAVLEDYPCLRLTHGRKVFEVRPVIDWNKGKAVEFLLESLGLNESEDVLPIYVGDDRTDEDAFKVLKASNRGFGILVSSIPKESDAFYSLRDPAEVMEFLRMLAAWKEQST

SEQ ID NO: 74 - protein, 140 aa, Populus balsamifera subsp. trichocarpa
  misc_feature: Ceres CLONE ID no.100029223
  misc_feature: Bit score of 311.9 for HMM based on sequences of FIGURE 10.
  misc_feature (53)..(114): Pfam Name: DnaJ Pfam Description: DnaJ domain
  misc_feature: Functional Homolog Of Ceres CLONE ID no. 31309 at SEQ ID NO. 60
MYATLPSPFLPKSIHAFSPNKTSSSLRTSARAASFKSATATEGNSAAVALAGSLYEILRVERTASLNEIKTAYRSLAKVYHPDANRSSSDGRDFIEIRNAYATLSDPTARAVYDMSLGVRARRIRTRVYPIRRWETDQCW

SEQ ID NO: 75 - DNA, 987 bp, Populus balsamifera subsp. trichocarpa
  misc_feature: Ceres ANNOT ID no.1442539
  misc_feature: Encodes the peptide sequence at SEQ ID NO 76
atggcctccacaacttgtctcacgtcttttagctcctccgcgtctccttttattggctcaaaagtttccaccaatcagtctcattcaccaccaccgtctcgcgtcagcttccgcccctttcgagtgtccgccgcctgcgcttcaaccgccgagagacccacatcatgcattgcaacagcaacatctgcatcatctctttacgaagttcttggaattcaaatgggcgccacgtgtcaggagatcaagacagcttatcgaagactggctagaatcttgcatcctgatgttgcagctaacgggcaaagggaggacaaggcttacgagttcatgagagtccacgaagcttatgaaaccctgtctgatcctgaaaaacgtgcagattatgatcgctccctttatagacgaggaaggcaaatgggctctccgtttgtgatgtctgctgctactgtaacaacaatggcaacaggattttctgggtatacaagtcagagatgggaaactgaccagtgctggtgtagcgatttgaagtgcccaattcctctacttttaaagtggaaacgcaaaaagatggagcagttccaaaaagcaaaagcaaaagcaaaaacaagaacagtgacccaaagacaggctttgccagacagaaatatcaaatacactgaaagaagcacaagttctaagactcgctcgcactcttggtttgaattgaagcacagagcgaaaaaaacagctcaatgcatggaaaaatccatgccacgtattaacaagcaagacagcatttcaccaaaaacagaagaaaagaggagcaagacagcaaccttcaagtcaatggctccgttgtcgacttgtcggtgtcttgcgtttggttgcaatcgaactgaaatgggacaagaccagacatcctttcctgacgcggtatctccaaatgtggatgagatggcagccacaatcacacggattagactcaacaagcacacagctcagtcttag

SEQ ID NO: 76 - protein, 328 aa, Populus balsamifera subsp. trichocarpa
  misc_feature: Ceres ANNOT ID no.1442539
  misc_feature: Bit score of 174.6 for HMM based on sequences of FIGURE 10.
  misc_feature (65)..(129): Pfam Name: DnaJ Pfam Description: DnaJ domain
  misc_feature: Functional Homolog Of Ceres CLONE ID no. 31309 at SEQ ID NO. 60
MASTTCLTSFSSSASPFIGSKVSTNQSHSPPPSRVSFRPFRVSAACASTAERPTSCIATATSASSLYEVLGIQMGATCQEIKTAYRRLARILHPDVAANGQREDKAYEFMRVHEAYETLSDPEKRADYDRSLYRRGRQMGSPFVMSAATVTTMATGFSGYTSQRWETDQCWCSDLKCPIPLLLKWKRKKMEQFQKAKAKAKTRTVTQRQALPDRNIKYTERSTSSKTRSHSWFELKHRAKKTAQCMEKSMPRINKQDSISPKTEEKRSKTATFKSMAPLSTCRCLAFGCNRTEMGQDQTSFPDAVSPNVDEMAATITRIRLNKHTAQS

SEQ ID NO: 77 - DNA, 510 bp, Populus balsamifera subsp. trichocarpa
  misc_feature: Ceres ANNOT ID no.1442538
  misc_feature: Encodes the peptide sequence at SEQ ID NO 78
atggcttccacatcttctctagcgtctttcagctcctcctcttctcctttcattggctcaaagttctcgaccaatcagcctcattcgcttccatttcgtgccagcttccgccccttcagtgtctctgcctcctgcgcttccaccgccgagcgaccaccatcccgcaatgccacgcaaatatctctctacgaagttctcgggattcaaatgggtgccacttgccaggaaatcaaggctgcttacagaaagctagcaagaacattgcatcctgatgttgcagctaacgttcaaaaggaagacacagcttatgagttcattaaagtacacgaagcttatgaaactctgtcggaccctgacaaacgtgcagattatgaccgttcgctttttagacctggaaggcaaatgagctctccgtttgtaatgtctgcagcaacaatggaaacaaatgttgtagctgctggatttcctgcctacactaggcgaagatgggaaactgatcagtgctggtag

SEQ ID NO: 78 - protein, 169 aa, Populus balsamifera subsp. trichocarpa
  misc_feature: Ceres ANNOT ID no.1442538
  misc_feature: Bit score of 169.2 for HMM based on sequences of FIGURE 10.
  misc_feature (61)..(125): Pfam Name: DnaJ Pfam Description: DnaJ domain
  misc_feature: Functional Homolog Of Ceres CLONE ID no. 31309 at SEQ ID NO. 60
MASTSSLASFSSSSSPFIGSKFSTNQPHSLPFRASFRPFSVSASCASTAERPPSRNATQISLYEVLGIQMGATCQEIKAAYRKLARTLHPDVAANVQKEDTAYEFIKVHEAYETLSDPDKRADYDRSLFRPGRQMSSPFVMSAATMETNVVAAGFPAYTRRRWETDQCW

SEQ ID NO: 79 - DNA, 324 bp, Populus balsamifera subsp. trichocarpa
  misc_feature: Ceres ANNOT ID no.1460661
  misc_feature: Encodes the peptide sequence at SEQ ID NO 80
atggctacaacttcctcattctatgaagtactagggcttccaatgaatactactagccatgaaataaaggctgcttatagaaaactagcaagaacttgccaccctgatgctgtgtctatgcataaaaaagaaatgtcagcctgtgagttcatcaaaatccatgcagcatattcaacattatcggaccctgataaacgtgaaagatatgatagagatctgtatagaaaccgtaggccttttgggtcttcttcagtgaggtcagcaacaatggcagctgcgtccggttataccagtaggaactgggagactgaccagtgttggtag

SEQ ID NO: 80 - protein, 107 aa, Populus balsamifera subsp. trichocarpa
  misc_feature: Ceres ANNOT ID no.1460661
  misc_feature: Bit score of 88.1 for HMM based on sequences of FIGURE 10.
  misc_feature (6)..(70): Pfam Name: DnaJ Pfam Description: DnaJ domain
  misc_feature: Functional Homolog Of Ceres CLONE ID no. 31309 at SEQ ID NO. 60
MATTSSFYEVLGLPMNTTSHEIKAAYRKLARTCHPDAVSMHKKEMSACEFIKIHAAYSTLSDPDKRERYDRDLYRNRRPFGSSSVRSATMAAASGYTSRNWETDQCW

SEQ ID NO: 81 - DNA, 528 bp, Populus balsamifera subsp. trichocarpa
  misc_feature: Ceres ANNOT ID no.1452884
  misc_feature: Encodes the peptide sequence at SEQ ID NO 82
atggccaccacatcttctcttgcatctcttagctcctccatatcccctttcactggctcaaaaacctccaccaatcagcctcatacatcaccatctcgtgtcagcttccgcccttttcgagtacgcgccgcctgcgctaccaccgccgagagacccacatcatacactgcgacaccaacatcagcatcgtctctctacgaagttcttgggattcaaatgggtgccacgtgtacagagatcaagactgcttatcgaagactagcaagagttttgcatcctgatgttgcagctaacggtagaagggaggacaccgcttatgagttcataagagtccatgaagcttacgaaactctgtccgatcctgaaaaacgggcagattatgatcgctccctttacagacgaggaaggcaaatgagctctccgtttgtaatgtccgctgctactgcaacaacaatggcaacaggttatgcagctgctggattttctggctatacaaggcggagatgggaaactgatcagtgctggtag

SEQ ID NO: 82 - protein, 175 aa, Populus balsamifera subsp. trichocarpa
  misc_feature: Ceres ANNOT ID no.1452884
  misc_feature: Bit score of 166.0 for HMM based on sequences of FIGURE 10.
  misc_feature (64)..(128): Pfam Name: DnaJ Pfam Description: DnaJ domain
  misc_feature: Functional Homolog Of Ceres CLONE ID no. 31309 at SEQ ID NO. 60
MATTSSLASLSSSISPFTGSKTSTNQPHTSPSRVSFRPFRVRAACATTAERPTSYTATPTSASSLYEVLGIQMGATCTEIKTAYRRLARVLHPDVAANGRREDTAYEFIRVHEAYETLSDPEKRADYDRSLYRRGRQMSSPFVMSAATATTMATGYAAAGFSGYTRRRWETDQCW

SEQ ID NO: 83 - DNA, 477 bp, Populus balsamifera subsp. trichocarpa
  misc_feature: Ceres ANNOT ID no.1450523
  misc_feature: Encodes the peptide sequence at SEQ ID NO 84
atgcttgcaactcctaccacttcatttctccaaatcaccaccacaaagacaccttgctcaagcccttttagtggcgagtcctatccacttaaacctagagcatcttttactactgcttcacaggccaaaaaatcacaagggagcgttgactcaatggctacaacctcctcattctacgaagtgctagggcttccaatgagtgctagtggccatgaaataaaggctgcttatagaagactagcaagaacttgccaccctgatgttgtgtccatgaatcagaaagaaatgtcatccactgagttcattaaaatccatgcagcatattcaacactgtcagacccagataaacgcgcaagttatgatagagatctttttagaaacagtaggcctttcgggtcttcttctatgaggtcggcaacaatggcagctgcttctggatatactagtaggaactgggagactgaccagtgttggtag

SEQ ID NO: 84 - protein, 158 aa, Populus balsamifera subsp. trichocarpa
  misc_feature: Ceres ANNOT ID no.1450523
  misc_feature: Bit score of 162.0 for HMM based on sequences of FIGURE 10.
  misc_feature (57)..(121): Pfam Name: DnaJ Pfam Description: DnaJ domain
  misc_feature: Functional Homolog Of Ceres CLONE ID no. 31309 at SEQ ID NO. 60
MLATPTTSFLQITTTKTPCSSPFSGESYPLKPRASFTTASQAKKSQGSVDSMATTSSFYEVLGLPMSASGHEIKAAYRRLARTCHPDVVSMNQKEMSSTEFIKIHAAYSTLSDPDKRASYDRDLFRNSRPFGSSSMRSATMAAASGYTSRNWETDQCW

SEQ ID NO: 85 - DNA, 495 bp, Populus balsamifera subsp. trichocarpa
  misc_feature: Ceres ANNOT ID no.1442257
  misc_feature: Encodes the peptide sequence at SEQ ID NO 86
atgtatgccatctcttccacccccgctctaaccaccgccgcaacggccgcggttaccgccaatatagtccaaaaaactttccttccatcgtcgatcacgacatcctccactcgttctctccggggatttcgaatcaaggcctcggtttcaacgtttcctgacactatccgagtagactcgaggaattcatctctgagtctgtacgaaatactccgggtcaatccaaccgcgtcgcaagtggagatcaagactgcgtatagaagtcttgctaaggtataccatcctgatgcgatgttagatcgcgatgatgagccatccgaaggtgttgattttattgagattcacaacgcttatgagacgttatcggatccggcagcgagagcggtttatgatatgtctttatcggcagccgcgagggatttttataggagagcggttggatattcgggtggatattatacgacccgaagatgggaaaccgatcagtgctggtaa

SEQ ID NO: 86 - protein, 164 aa, Populus balsamifera subsp. trichocarpa
  misc_feature: Ceres ANNOT ID no.1442257
  misc_feature: Bit score of 161.8 for HMM based on sequences of FIGURE 10.
  misc_feature (66)..(131): Pfam Name: DnaJ Pfam Description: DnaJ domain
  misc_feature: Functional Homolog Of Ceres CLONE ID no. 31309 at SEQ ID NO. 60
MYAISSTPALTTAATAAVTANIVQKTFLPSSITTSSTRSLRGFRIKASVSTFPDTIRVDSRNSSLSLYEILRVNPTASQVEIKTAYRSLAKVYHPDAMLDRDDEPSEGVDFIEIHNAYETLSDPAARAVYDMSLSAAARDFYRRAVGYSGGYYTTRRWETDQCW

SEQ ID NO: 87 - DNA, 420 bp, Populus balsamifera subsp. trichocarpa
  misc_feature: Ceres ANNOT ID no.1541121
  misc_feature: Encodes the peptide sequence at SEQ ID NO 88
atgctctctccctgcctctccacttctgctcctccacgtgtaacattcaagcgaccgttagtaacgaacagcaccaccaccactctcccgccgcgaaatctgtctctgaagaaacctcaaggcatggcctcatctttgtacgagattctaaggattccggtgggggcaacaaaccaggagatcaagactgcttaccggagactggccaggacttaccaccctgacgtggttgccgaggaccggaaagacacatctgctgacgagtttatgaagttacacgctgcctattcaactctatcagacccggaaaagcgggctgtttatgatagtaagctatttataaggaagcagcggccattgaccaccgtggggttttcgggctatagtggccggacatgggaaactgatcagtgttggtag

SEQ ID NO: 88 - protein, 139 aa, Populus balsamifera subsp. trichocarpa
  misc_feature: Ceres ANNOT ID no.1541121
  misc_feature: Bit score of 200.0 for HMM based on sequences of FIGURE 10.
  misc_feature (45)..(109): Pfam Name: DnaJ Pfam Description: DnaJ domain
  misc_feature: Functional Homolog Of Ceres CLONE ID no. 31309 at SEQ ID NO. 60
MLSPCLSTSAPPRVTFKRPLVTNSTTTTLPPRNLSLKKPQGMASSLYEILRIPVGATNQEIKTAYRRLARTYHPDVVAEDRKDTSADEFMKLHAAYSTLSDPEKRAVYDSKLFIRKQRPLTTVGFSGYSGRTWETDQCW

SEQ ID NO: 89 - DNA, 516 bp, Populus balsamifera subsp. trichocarpa
  misc_feature: Ceres ANNOT ID no.1480481
  misc_feature: Encodes the peptide sequence at SEQ ID NO 90
atgtacactacgttcgctccctcccctctaaccgctgtgacctccgtaatcaccgccgcggcaacctcgaacacagttcaaaagcctatccttttatcaccggttaaaacaaccgccggtcgttcttgtcgggggtttcaaatcaaagcctcggtctcaacgtttcctgactcgacccgagtcgactcaaggtattcaacgctgagtctgtacgatgtactccgggtgaatccagctgcgtcgcaagtggagatcaagtcagcgtacaggagtcttgcgaagatttaccatcctgatgcttttttgagtcatgatcgtgatcatgatgacgagcaatcggacggtggagattttatcgagattcatagtgcttatgagacgttatccgatccgactgctagagcggtttatgacctgtctttatcggcagcggcgaggtgtttttacaggagagcggccgggtattcgggcggggattatacgacccgaagatgggaaacagatcagtgctggtaa

SEQ ID NO: 90 - protein, 171 aa, Populus balsamifera subsp. trichocarpa
  misc_feature: Ceres ANNOT ID no.1480481
  misc_feature: Bit score of 138.1 for HMM based on sequences of FIGURE 10.
  misc_feature (69)..(138): Pfam Name: DnaJ Pfam Description: DnaJ domain
  misc_feature: Functional Homolog Of Ceres CLONE ID no. 31309 at SEQ ID NO. 60
MYTTFAPSPLTAVTSVITAAATSNTVQKPILLSPVKTTAGRSCRGFQIKASVSTFPDSTRVDSRYSTLSLYDVLRVNPAASQVEIKSAYRSLAKIYHPDAFLSHDRDHDDEQSDGGDFIEIHSAYETLSDPTARAVYDLSLSAAARCFYRRAAGYSGGDYTTRRWETDQCW

SEQ ID NO: 91 - DNA, 639 bp, Populus balsamifera subsp. trichocarpa
  misc_feature: Ceres ANNOT ID no.1487713
  misc_feature: Encodes the peptide sequence at SEQ ID NO 92
atgctctctccctgcctctccacttctgctcctccacgtgtaacattcaagcgaccgttagtaacgaacagcaccaccaccactctcccgccgcgaaatctgtctctgaagaaacctcaaggcatggcctcatctttgtacgagattctaaggattccggtgggggcaacaaaccaggagatcaagactgcttaccggagactggccaggacttaccaccctgacgtggttgccgaggaccggaaagacacatctgctgacgagtttatgaagttacacgctgcctattcaactctatcagacccggaaaagcgggctgtttatgatagtaagctatttataaggaagcagcggccattgaccaccgtggggttttcgggctatagtggccggacatgggaaactgatcagtgttgcttctcttctcctctgcgcagcagttctcttcttgacaaaagagaagagattgaaggcatctgggcaatcgttatttccaaagtaagaggaattggaggtagctccagcagaaaagcaaaaatggaaagtgacccagcccagtggagggcaagtttttctttagaaaacgacatagcaaacttgaatgttcgtgagcttgatcccacactgcaccttgagtaa

SEQ ID NO: 92 - protein, 212 aa, Populus balsamifera subsp. trichocarpa
  misc_feature: Ceres ANNOT ID no.1487713
  misc_feature: Bit score of 189.7 for HMM based on sequences of FIGURE 10.
  misc_feature (45)..(109): Pfam Name: DnaJ Pfam Description: DnaJ domain
  misc_feature: Functional Homolog Of Ceres CLONE ID no. 31309 at SEQ ID NO. 60
MLSPCLSTSAPPRVTFKRPLVTNSTTTTLPPRNLSLKKPQGMASSLYEILRIPVGATNQEIKTAYRRLARTYHPDVVAEDRKDTSADEFMKLHAAYSTLSDPEKRAVYDSKLFIRKQRPLTTVGFSGYSGRTWETDQCCFSSPLRSSSLLDKREEIEGIWAIVISKVRGIGGSSSRKAKMESDPAQWRASFSLENDIANLNVRELDPTLHLE

SEQ ID NO: 93 - DNA, 429 bp, Populus balsamifera subsp. trichocarpa
  misc_feature: Ceres ANNOT ID no.1456204
  misc_feature: Encodes the peptide sequence at SEQ ID NO 94
atgaatgcaacaacactattcaccgtctccccactcctttcatcgctggcgaaccgccggggagtctcaattaaagccgccgtgtcaacattagcggccgagtctttccgagttgacccagggaggaagtcgctgagtctgtacgagattcttcaagttaagagaacggcgtcgttaacggagattaagggtgcgtttaggagtctagccaaggtttatcatcctgatgtgagcggtagtgatggtggagagcaattggacggtctggattttgttgagatatgtaatgcctatgaaacgctgtcggatcccgctgctcgtgctatgtatgatttgtcgttgggttacagtagtagcaggaagagaccggttaggttttccggtgggtattctctgaaccggcggtgggaaactgatcagtgctggtaa

SEQ ID NO: 94 - protein, 142 aa, Populus balsamifera subsp. trichocarpa
  misc_feature: Ceres ANNOT ID no.1456204
  misc_feature: Bit score of 133.6 for HMM based on sequences of FIGURE 10.
  misc_feature (46)..(111): Pfam Name: DnaJ Pfam Description: DnaJ domain
  misc_feature: Functional Homolog Of Ceres CLONE ID no. 31309 at SEQ ID NO. 60
MNATTLFTVSPLLSSLANRRGVSIKAAVSTLAAESFRVDPGRKSLSLYEILQVKRTASLTEIKGAFRSLAKVYHPDVSGSDGGEQLDGLDFVEICNAYETLSDPAARAMYDLSLGYSSSRKRPVRFSGGYSLNRRWETDQCW

SEQ ID NO: 95 - DNA, 624 bp, Brassica napus
  misc_feature: Ceres Clone ID no. 964616
  misc_feature: Encodes the peptide sequence at SEQ ID NO. 746
aattctcctgtcgttgtttcctttcaagaaaaagagagagagagagagagaggaaataacgtccgtttgaagatccaaatctcggcaatgtcgacgttctcgccatcgttggccgtcctctctctgattcttctgagcctctctctggtttcatcgacggagattaacaagggaggagagattcgattaccttccgagaagaccaacggtgaattctgcgggaaaacgtctaaaccggcttcgtgtccggttaagtgttttagggctgatccggtttgcggagaagacggcgttacgtactggtgcggttgtgcagatgctctgtgccacggcgttcgtgtctctaaacctggagcttgtgatgttggtaatggcgttgggttgtctgttcctggacaagctctgcttttgatccacattgtctggatgatggctcttgggttttcgatcctctttggcctcttctgattttttttttttgttggggattaagaagatagagattggtaggttttgaggttgcaaccactgaatctttttgttgataatcattgatataaaatgttgagttttatttcctaattgatgtgcagaaaaaaaaaatgatatgtattgatatattac

SEQ ID NO: 96 - protein, 360 aa, Populus balsamifera subsp. trichocarpa
  misc_feature: Ceres ANNOT ID no.1473094
  misc_feature: Bit score of 473.5 for HMM based on sequences of FIGURE 9.
  misc_feature (71)..(329): Pfam Name: Trehalose_PPase Pfam Description: Trehalose-phosphatase
  misc_feature: Functional Homolog Of Ceres SEEDLINE ID no. ME20095 at SEQ ID NO. 1129
MGFQRSSYWQKVQPGSDLSTKETAPNSSHPVTNEAVSDDADYSSWMVDHPSALTSFDQMMKDAKGKKIVVFLDYDGTLSPIVNDPDRAFMSDEMRAAVREVAKYFPTAIISGRSRDKFMRQSLRMSMVSFVQVKGFVQLNNIYYAGSHGMDIMAPPRPARSSDGKYHTVSLDRKGNDAVFQPAQKFLPAIQKILKELEEAIMKIPGARVENNRFCASVHFRQVREEDYGTLEEKVKSILKHYPDFRLGWGKKVMEIRPSIEWDKGNALEYLLDTLGLGNCTDVLPLYIGDDITDEDAFKVIQKRGQGCPIVVTSSPKDTKASYSLYEPSEVLTFLLRLARWRKSSSSSRSVLSQVWGVSG

SEQ ID NO: 97 - DNA, 1025 bp, Gossypium hirsutum
  misc_feature: Ceres CLONE ID no.1939845
  misc_feature: Encodes the peptide sequence at SEQ ID NO 98
gaaacaaaggtattccataatccaaaagcgcgtaccatgctctcttcccttcccatctcaaattctatctccctttcctcaatttctcctccgtcagcttcccgtatccgattccgaccacctctcgccgccgcatccaccgcctattttacttcaaaacaacaaaaagcttcgcccagcggttaccttagccgtccaggaatggcagcgtgcacttcgttgtacgaggtgctagggatttctgtcggcgcttcgaaccaggaaatcaaggcggcgtaccgccgattggcaagggtttgccaccccgatgtggtgacaatcgatcggaaagactcatcggccgacgaattcatgaagatccatgcggcctacagtaccttatcggatcccgataaacgagccgtatatgatagtaagcttatctggagatgccaacggccgttgacttcggcttctatgttttctggttataccgggaggagttgggagaccgatcagtgttggtaaattagttgactcactccatctgcctaccgagttggaggttgaactcatcaacgtttcttataaatctgtacagttagattatatcccagcaaaaaaaaaaaaactgattgactaacgaaaaagaaaggaaaaagcaaagagtggtgggccgtgggttttggtggagaaatcagaggcgttgatagtggtacgtaagagctctgctctttttttgccctgtgcccggcatctacaaaagatggacccttccattgtactttcagtactatttcacggtgattaaaatcataaatacaaaataaaaatgacaaataacttgttgttaagctgaatttatattattagctgtgatattgtgcggtgaagtttctattccgagttgacaaatggaaaggaaaattttatccaaatcaacttttttcctctcatcatttttctttttgtatctcaagaaacaaaatttgctgaattaatattcttataccagttgattaagataaaaaaaaaaaaaaaaaaaa

SEQ ID NO: 98 - protein, 156 aa, Gossypium hirsutum
  misc_feature: Ceres CLONE ID no.1939845
  misc_feature: Bit score of 359.9 for HMM based on sequences of FIGURE 10.
  misc_feature (61)..(125): Pfam Name: DnaJ Pfam Description: DnaJ domain
  misc_feature: Functional Homolog Of Ceres CLONE ID no. 31309 at SEQ ID NO. 60
MLSSLPISNSISLSSISPPSASRIRFRPPLAAASTAYFTSKQQKASPSGYLSRPGMAACTSLYEVLGISVGASNQEIKAAYRRLARVCHPDVVTIDRKDSSADEFMKIHAAYSTLSDPDKRAVYDSKLIWRCQRPLTSASMFSGYTGRSWETDQCW

SEQ ID NO: 99 - DNA, 754 bp, Zea mays
  misc_feature: Ceres CLONE ID no.1387402
  misc_feature: Encodes the peptide sequence at SEQ ID NO 100
atatctaaatcctctttctctctgcttcttcaaattttacagtttctttctaaagctgccctcgaattttacattaattacataaatgtccggaatcttagttaattctgccgctaactccctccgcttctcgccgggagctagccttcctcatccgaagccaaccagatcacacaacggcagcgcgcggttccccaccggagccaactcgttcagagcttccgcgcagactctcaacgcggagccaaccgtaacggaatccgttcgccggcgagcgtcgagcctctacgatctgctgaaagtcaacgaaacggcgtccttgccggagatcaagacggcgtaccggagcctagctaaagtctaccatcccgacgcgtcggagtcggacgggcgagatttcatggagatccacaaagcttacgcgacgctcgcggatccgacgacgagagcgatctacgattcgacgctgggagcgcgacggagacgtgtgcaggtcggggcgatgggtcgggcgggtcgggtgtattcgacgacccggagatgggagacggatcagtgttggtgatttaggtttcaggtgatgatgactttgcagcaagggcacttttttttacttcatttttccccttttgttacttttttttttttccttttgtcgtgtattgggaaaattaaggggaaagataagttttatcagtccttagctttaactttgttaacataaattatgaatagagagatgtatattattttt

SEQ ID NO: 100 - protein, 159 aa, Zea mays
  misc_feature: Ceres CLONE ID no.1387402
  misc_feature: Bit score of 351.3 for HMM based on sequences of FIGURE 10.
  misc_feature (66)..(125): Pfam Name: DnaJ Pfam Description: DnaJ domain
  misc_feature: Functional Homolog Of Ceres CLONE ID no. 31309 at SEQ ID NO. 60
MSGILVNSAANSLRFSPGASLPHPKPTRSHNGSARFPTGANSFRASAQTLNAEPTVTESVRRRASSLYDLLKVNETASLPEIKTAYRSLAKVYHPDASESDGRDFMEIHKAYATLADPTTRAIYDSTLGARRRRVQVGAMGRAGRVYSTTRRWETDQCW

SEQ ID NO: 101 - DNA, 659 bp, Panicum virgatum
  misc_feature: Ceres CLONE ID no.2015383
  misc_feature: Encodes the peptide sequence at SEQ ID NO 102
aacccacctctcacaaaatctctctctcacccaaggctcggccaatcccgatccctccctccccgtcccgccactccaccgccagcgccagcatgatctccccgcgccccgcgatgtcgcccagcttcctcgccttccggccgggctccccggccgcgtccccgccgccctccccgcgcctcaacgggccgccgcccctctccgcgtccttctccgcctccacggccgtcaccgccccggaccacgcggcggccgccagctcctccttctacgacgtcctcggcctccgcccgggcgccagcccgcgcgagatcaagaccgcgtaccgccgcctggcgctcgccgtccacccggacgccgccccgcacccggcctcctcctccgccgaggacttcatccgcgtccacgccgcctactccacgctctccgaccccgacaagcgcgccgactacgaccgccgcctcctcctctccgccgggcgccgccgcgcgcacccggcggcgctcggccgctcgccctccttcccggcgcgccgctcccgccgcacctgggagaccgaccagtgctggtgacagcgtaaagatcttccgcgcctgcggctgtggcggcccctcgctgtccccgtcgggccgcggaaccttcccatttgaatggagcct

SEQ ID NO: 102 - protein, 159 aa, Panicum virgatum
  misc_feature: Ceres CLONE ID no.2015383
  misc_feature: Bit score of 348.3 for HMM based on sequences of FIGURE 10.
  misc_feature (58)..(121): Pfam Name: DnaJ Pfam Description: DnaJ domain
  misc_feature: Functional Homolog Of Ceres CLONE ID no. 31309 at SEQ ID NO. 60
MISPRPAMSPSFLAFRPGSPAASPPPSPRLNGPPPLSASFSASTAVTAPDHAAAASSSFYDVLGLRPGASPREIKTAYRRLALAVHPDAAPHPASSSAEDFIRVHAAYSTLSDPDKRADYDRRLLLSAGRRRAHPAALGRSPSFPARRSRRTWETDQCW

SEQ ID NO: 103 - DNA, 689 bp, Parthenium argentatum
  misc_feature: Ceres CLONE ID no.1607893
  misc_feature: Encodes the peptide sequence at SEQ ID NO 104
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
atccacttcatctcaccactcaaaaacattccttaaaaacatttcacaaacatattttcctcaaacaaaaaatggctttttcatcttctagttctccttgcttcttcccttcccataatttaaccaacttaagatacaataaacataattcacctatgatctcagccagtttcgccacatccgagaggccgggaacagcccgatccactcgggctactccttcgtcactatacgaagtgctcgggatacaaataggagccgatacgatggaaatcaagtcggcataccgtagattggcaagagttgtgcatccggacgtgggaaaccttaattcgtccgcggacgagtttatgaaagtgcattcggcttacgctacgttatcggatccaggaaagcgagccgattatgatcggagtttgtttgtgagaccggaaatggttggccggagttgttctccggtgggttatagtggtcggagatgggagacagatcagtgttggtagtatgtggtgggtctgcacgtgtatatgtagttttttgttnnntagtatggatggcaacgggtcgggtatgggccgggtttggctaatcccatacccataccctnnnatgaaatctcatcacatacccgccccatttacccgtcgggtttatgtcgggtattacccgtcgggtatagagcatacccg

SEQ ID NO: 104 - protein, 143 aa, Parthenium argentatum
  misc_feature: Ceres CLONE ID no.1607893
  misc_feature: Bit score of 337.6 for HMM based on sequences of FIGURE 10.
  misc_feature (52)..(113): Pfam Name: DnaJ Pfam Description: DnaJ domain
  misc_feature: Functional Homolog Of Ceres CLONE ID no. 31309 at SEQ ID NO. 60
MAFSSSSSPCFFPSHNLTNLRYNKHNSPMISASFATSERPGTARSTRATPSSLYEVLGIQIGADTMEIKSAYRRLARVVHPDVGNLNSSADEFMKVHSAYATLSDPGKRADYDRSLFVRPEMVGRSCSPVGYSGRRWETDQCW

SEQ ID NO: 105 - DNA, 505 bp, Brassica napus
  misc_feature: Ceres CLONE ID no.972919
  misc_feature: Encodes the peptide sequence at SEQ ID NO 106
cctcttgtgtgattcatatctgcttctcagacgaactctctctgcttaatccaaattttaacgcgttctttcgaatttgcccctccaattttaatttaattacgtaaatgtccggaactctaatctacttaggcgttaactcccttcgatcctcgccgggaaatagccttcgtcaaccgaagccaaccagactccacaacggaaacgcgcggctctccaccggagctacgtcgtttagagcttcggcagcgcagactctcaacgccgaaccagccgtaacggaatccgttcgccggcgagcgtcgaacctctacgaactgctgagagtggacgaaacggcgtcgttgacggagattaagacggcgtaccggagcttagctaaggttcaccatccggacgcgtcgtcggaatcggacggacgagatttcatggagattcacaaagcttacgcgacgctggcggatccgacgacgagagcgatctacgattcgacgctgggagcaag

SEQ ID NO: 106 - protein, 132 aa, Brassica napus
  misc_feature: Ceres CLONE ID no.972919
  misc_feature: Bit score of 250.6 for HMM based on sequences of FIGURE 10.
  misc_feature (67)..(127): Pfam Name: DnaJ Pfam Description: DnaJ domain
  misc_feature: Functional Homolog Of Ceres CLONE ID no. 31309 at SEQ ID NO. 60
MSGTLIYLGVNSLRSSPGNSLRQPKPTRLHNGNARLSTGATSFRASAAQTLNAEPAVTESVRRRASNLYELLRVDETASLTEIKTAYRSLAKVHHPDASSESDGRDFMEIHKAYATLADPTTRAIYDSTLGA

SEQ ID NO: 107 - DNA, 622 bp, Glycine max
  misc_feature: Ceres CLONE ID no.1645860
  misc_feature: Encodes the peptide sequence at SEQ ID NO 108
aacattccattcccaatttccatatcccaacggatcgcaatatagcaagtagcgaacatgatttcttccgtgtcctttccagcgtctcttcccgccgttaacttctccggcaacgccgtggcttctccgtcgtgccgcgtcaaatccaggcctatagttgccttcgccaccgccaccgccaccgcggaagctcgctcttcctggacggagcaaccgagaccttcgtatctgaactcctcttgctcttcgctctacgaggttctcggcatccccgccggcgcctctaaccaagaaatcaaggcggcgtaccggcgactggccagagtcttccaccccgacgtggcggcgattgaccggaaaaactcatccgccgatgagttcatgaagatccacgctgcgtactctactctctcggatcccgacaagcgcgccaactacgatcagaggctcttccggcgacaacggccgttgtcgacggcggcggtgttctccggttatacgcgtcggaactgggaaacggatcagtgttggtagtgagtcactgagtcgactcgctcgagtgaatgggaaaagacgcggttgttgaagcgcctttccttgcatatagtaaaaataatcacta

SEQ ID NO: 108 - protein, 158 aa, Glycine max
  misc_feature: Ceres CLONE ID no.1645860
  misc_feature: Bit score of 211.3 for HMM based on sequences of FIGURE 10.
  misc_feature (64)..(128): Pfam Name: DnaJ Pfam Description: DnaJ domain
  misc_feature: Functional Homolog Of Ceres CLONE ID no. 31309 at SEQ ID NO. 60
MISSVSFPASLPAVNFSGNAVASPSCRVKSRPIVAFATATATAEARSSWTEQPRPSYLNSSCSSLYEVLGIPAGASNQEIKAAYRRLARVFHPDVAAIDRKNSSADEFMKIHAAYSTLSDPDKRANYDQRLFRRQRPLSTAAVFSGYTRRNWETDQCW

SEQ ID NO: 109 - DNA, 809 bp, Glycine max
  misc_feature: Ceres CLONE ID no.1042804
  misc_feature: Encodes the peptide sequence at SEQ ID NO 110
attccttcccaatttctcccacgacaacgtatcacaagctcccaatatagcaagcagcaaacatgatttcttccgtgtcctttccagcgtctcttcccgccgttaacttctccggcaacgccatggcttcgccgtcgtgccgcgtcaaatcccggccaatagtcgccttcgccaccgccactgccaccgctgaagctcgctcttcctggacggagcaaccgagaccttcctatctgaactcctcttgctcttcgctttacgatatcctcggcatccccgctggcgcctctaaccaagaaatcaaggccgcgtaccggcgactagccagagtctgccaccccgacgtggcggccatcgaccggaaaaattcgtccgctgacgaattcatgaagatccacgccgcgtactctactctttctgatcccgacaagcgcgctaactacgatcggagcctattccggcgacaacggccgttgtcgacggcggcggtgttytccggttacacgsgtcggaactgggaaacggatcagtgctggtagtgagtcmctgagtcgactcgctcgagtgaatgaragaagacscggttattgaagcscctttytttgcatataagtaattaatcmctagttagttagtcgttaragtttgtatgatactacgtatatgtatagctacatacatacatatacgsgtagagtagaatagactgccmcttgtactgagkactyttgtaawataaacttttcatcaaaaattttatggatgaaaaagaaaaaaaaaaaaacagaaaagaaaattgactttggtat

SEQ ID NO: 110 - protein, 158 aa, Glycine max
  misc_feature: Ceres CLONE ID no.1042804
  misc_feature: Bit score of 209.5 for HMM based on sequences of FIGURE 10.
  misc_feature (64)..(128): Pfam Name: DnaJ Pfam Description: DnaJ domain
  misc_feature: Functional Homolog Of Ceres CLONE ID no. 31309 at SEQ ID NO. 60
  misc_feature (144)..(144): Xaa is any aa, unknown, or other
  misc_feature (149)..(149): Xaa is any aa, unknown, or other
MISSVSFPASLPAVNFSGNAMASPSCRVKSRPIVAFATATATAEARSSWTEQPRPSYLNSSCSSLYDILGIPAGASNQEIKAAYRRLARVCHPDVAAIDRKNSSADEFMKIHAAYSTLSDPDKRANYDRSLFRRQRPLSTAAVXSGYTXRNWETDQCW

SEQ ID NO: 111 - DNA, 645 bp, Parthenium argentatum
  misc_feature: Ceres CLONE ID no.1606678
  misc_feature: Encodes the peptide sequence at SEQ ID NO 112
atccactccaaaacccacacaaaatcatttattcacacattcaccccaaaacgatgtcgttttcatcatcttcttcttcttcctgtttcttcactccccctaatttcaccgtcaataaaccatctccgtcaaccaacgtccgttacagaaaccataattcactatacgatgtgctcggagtacaaattggggcagatacggtggagataaaggcggcgtaccggagattagcgagagtgttgcatccggacgtcggaactagggattcgtcggcggatgagtttatgaaagtgcattctgcgtacgctacgttgtcggatccaggaaaacgagcggattatgatcggagtttgttccttagacagagagtggttggccggagttcgtctccggtgggatatggtggttatagtggccggagatgggagacggaccagtgttggtagttgtttgtacggtggattggtttctagtgtacatatctgtagctaaaagtttaggttaaaaagttgaaaggtataaatatgatgtgtaaattagtaaatggttatattttttataaaccaagttattactgaatatattgtagatttgtggatcaaagcattttttttttttgattgatgcaatggggtgactttatct

SEQ ID NO: 112 - protein, 130 aa, Parthenium argentatum
  misc_feature: Ceres CLONE ID no.1606678
  misc_feature: Bit score of 209.5 for HMM based on sequences of FIGURE 10.
  misc_feature (36)..(97): Pfam Name: DnaJ Pfam Description: DnaJ domain
  misc_feature: Functional Homolog Of Ceres CLONE ID no. 31309 at SEQ ID NO. 60
MSFSSSSSSSCFFTPPNFTVNKPSPSTNVRYRNHNSLYDVLGVQIGADTVEIKAAYRRLARVLHPDVGTRDSSADEFMKVHSAYATLSDPGKRADYDRSLFLRQRVVGRSSSPVGYGGYSGRRWETDQCW

SEQ ID NO: 113 - DNA, 886 bp, Triticum aestivum
  misc_feature: Ceres CLONE ID no.684496
  misc_feature: Encodes the peptide sequence at SEQ ID NO 114
ctgattggtgattgcctcctcgtccggcgttaaaaagcagcctcggctcctccgcgcatccgaaccgagcctcgccaccatgatctccccgcgccccactctctcctccggcttcttctcccgctccgcctccttctcccgccccggctcattctccccctcgccgcctgcctcgccggccgcgcaggcgccgccgcggctgctctcggccccgttcgcgcgccacgccaccttctcccgctccgcctccgccgtcgccgcgccgggccgcggcgcctcctcctgcttgtacgacgtgctcggcctcgacgccggcgcgagcgacggggagatcaaggccgcgtaccgccgcctggcgcgcgccgtccacccggacgtgtccccgcaccccgccgcgtccgccgacgacttcatacgggtgcacgccgcctacagcacgctctccgaccccagcaagcgcgccgactacgaccgccgcatgatcatgatcccctccgccgtcggccgccgcagcgcccccaacctcgcccgctcgccgtcgttccccgggtgctgccgccgcacctgggagaccgaccagtgctggtgatcgacgttttcggccggagtggcctccggctggttccccgggcggttagaaatgcaaaggttaccgcggccactaggctcacttgcagtggtggccgggtcactgcgcttctagaataaacagtagtagtacgtactctgttattagcgcaacgtacaattagtctcacacttcgctgtggcttgtatagaaaacaaaagatcgatgtatggcgtcgtgtgtgacgtccgtctattttgaagtttatcatgcatgttcggcttgatgtggtgatctgacagtaggatttgttaaatc

SEQ ID NO: 114 - protein, 169 aa, Triticum aestivum
  misc_feature: Ceres CLONE ID no.684496
  misc_feature: Bit score of 181.8 for HMM based on sequences of FIGURE 10.
  misc_feature (69)..(131): Pfam Name: DnaJ Pfam Description: DnaJ domain
  misc_feature: Functional Homolog Of Ceres CLONE ID no. 31309 at SEQ ID NO. 60
MISPRPTLSSGFFSRSASFSRPGSFSPSPPASPAAQAPPRLLSAPFARHATFSRSASAVAAPGRGASSCLYDVLGLDAGASDGEIKAAYRRLARAVHPDVSPHPAASADDFIRVHAAYSTLSDPSKRADYDRRMIMIPSAVGRRSAPNLARSPSFPGCCRRTWETDQCW

SEQ ID NO: 115 - DNA, 856 bp, Zea mays
  misc_feature: Ceres CLONE ID no.1062366
  misc_feature: Encodes the peptide sequence at SEQ ID NO 116
atctctcttcatttccctctctcgaacaagaagacaacaactcaaaacgcagagaagatctccagaacgacaccgtttcgtagcaaagatgctttcttcgtctccaacctccttcactcatccattcctctccacgtctccgcctctctcccccatatctccgccgtctcgctcacctcgcctcccgcctcctctcgtctccgcctcttgctcctacacctgcacggaggatccgccgaggctgcaccagatcccgcggcgaacgacgccggcgaacgcttcgctctacgagattctagaggttcctcgcggcgcgacgagccaggatatcaaatcggcttaccggaggttggctaggatctgccaccccgacgtggcggcgggaaccgatcggagtaactcttcggcggatgagttcatgaagatccacgcggcgtactgtacgctctctgatcctgacaaacgctctgtttacgatcggaggatgcttcgtcggagccgtccgttgaccgtcagcacctccgggatgggcagttacgttggacggaactgggaaaccgatcagtgctggtagcgagttgactcggtgaccgagttagctcgagttaattcgaattaataaaacacggttgtaaaaataggaagcgataaaagctggggttagcgatgtaattaacagtagtattagtgtgctaacatacgccaagagctaaacgtacgctccctctccctgcccacggccacgggcgatcagcgccgtttgcatcgtgttacgtaggatctacgtgtgttttttttttaccttctgaatcctgtaatacttatcaatgaaaacaaaataaacactgttataatt

SEQ ID NO: 116 - protein, 161 aa, Zea mays
  misc_feature: Ceres CLONE ID no.1062366
  misc_feature: Bit score of 168.8 for HMM based on sequences of FIGURE 10.
  misc_feature (65)..(130): Pfam Name: DnaJ Pfam Description: DnaJ domain
  misc_feature: Functional Homolog Of Ceres CLONE ID no. 31309 at SEQ ID NO. 60
MLSSSPTSFTHPFLSTSPPLSPISPPSRSPRLPPPLVSASCSYTCTEDPPRLHQIPRRTTPANASLYEILEVPRGATSQDIKSAYRRLARICHPDVAAGTDRSNSSADEFMKIHAAYCTLSDPDKRSVYDRRMLRRSRPLTVSTSGMGSYVGRNWETDQCW

SEQ ID NO: 117 - DNA, 564 bp, Musa acuminata
  misc_feature: Ceres CLONE ID no.1722931
  misc_feature: Encodes the peptide sequence at SEQ ID NO 118
acccaactcggaatctatctcgtccatgatatcgtcgctgtgcctcgcttcccccaaatccttcctccgccccccgcgctgcgtcgccgcctccgccgccgcagcccctcctgccgtctgctcgtccgtgacgctatacgacgtgctcggcatcgccgccggcgcatccggccgcgagatcaaggcggcgtaccggaggcttgcccttgcgtgccacccggacgtggccgcggtcgagcggaggggcgcgtccgcggtcgagttcatgcgggtccacgcggcttacgagactctctctgatccggagaagcgcgccgactacgaccgcagcgtcatgacagcggtggacgccggccgacggtgggcgcccttccgctcgcagtggacgtcgtcgcactccaccggtcgccgccgtcctcgcacgtgggagacggaccagtgctggtagcactcggaccgatccaccacatcagtgtacagattttgagggatgttttacatcaatttcccttggttagatttgtataagaaaatcgaagtcatacataggcgtccccatttttc

SEQ ID NO: 118 - protein, 148 aa, Musa acuminata
  misc_feature: Ceres CLONE ID no.1722931
  misc_feature: Bit score of 137.8 for HMM based on sequences of FIGURE 10.
  misc_feature (44)..(108): Pfam Name: DnaJ Pfam Description: DnaJ domain
  misc_feature: Functional Homolog Of Ceres CLONE ID no. 31309 at SEQ ID NO. 60
PNSESISSMISSLCLASPKSFLRPPRCVAASAAAAPPAVCSSVTLYDVLGIAAGASGREIKAAYRRLALACHPDVAAVERRGASAVEFMRVHAAYETLSDPEKRADYDRSVMTAVDAGRRWAPFRSQWTSSHSTGRRRPRTWETDQCW

SEQ ID NO: 119 - DNA, 758 bp, Glycine max
  misc_feature: Ceres CLONE ID no.746169
  misc_feature: Encodes the peptide sequence at SEQ ID NO 120
acccaaacacggttctaacatatctcattccaatttcgcccctcgccggaaaaagaaaacctcaccgcaacgttcgattcagtttccgatggcgccagcgctgaacctcgccgccggaggaattccgctgagtttctcttcctccgtcgaccgctccgccagctttccacggcggtcctcggtccgcgccgtcgcggctgaggcggtggatacgcagcggccggcggcgagcctttacgaggtgctgcgagtcgagcgagacgcatcgccgacggagatcaagtcggcgtaccggagcctcgcgaagctctaccatcccgatgcggcggtgcagaggtcaccggagactgacggcgacggagacttcattcagctccgaaacgcgtacgagacgctgtcggatccgtcggcgagggcgatgtacgataggacgctggcggcggcgcacggcggaagacaccgccggttttctacttcgcttagtcggaaccactcgtcggcgttttacacgacgcgaaggtgggaaacggaccaatgctggtagaggaattagcaaagaaaaatgtggatttgttaacaagaaagaggaatcgccgaatcggtgaaaacgatgtcaaaaagagtgatgagaatcggaaattactaacttagatggatagagcaaacaaagagagagagagagagaggatgaagaagcaaattttgcttctctttttgtgagaatgtaaatgattttttttttaaaaaaaaaaaaaaaa

SEQ ID NO: 120 - protein, 151 aa, Glycine max
  misc_feature: Ceres CLONE ID no.746169
  misc_feature: Bit score of 136.6 for HMM based on sequences of FIGURE 10.
  misc_feature (48)..(113): Pfam Name: DnaJ Pfam Description: DnaJ domain
  misc_feature: Functional Homolog Of Ceres CLONE ID no. 31309 at SEQ ID NO. 60
MAPALNLAAGGIPLSFSSSVDRSASFPRRSSVRAVAAEAVDTQRPAASLYEVLRVERDASPTEIKSAYRSLAKLYHPDAAVQRSPETDGDGDFIQLRNAYETLSDPSARAMYDRTLAAAHGGRHRRFSTSLSRNHSSAFYTTRRWETDQCW

SEQ ID NO: 121 - DNA, 602 bp, Glycine max
  misc_feature: Ceres CLONE ID no.1050475
  misc_feature: Encodes the peptide sequence at SEQ ID NO 122
aaaataattcccaagcctcaacttctaacaacgacgtcgtcgcgtatggtgcccaaacatactcacagcatctttccctacactgaccaccgctttctccaccaaaggagtctcctcgccgccgcgccacgtcagattccggtcagcttcgtatccgtgccctcacgggatggcttcgagcgcgacgctctaccagattctgggagtccgcgccgtcgcatccggcgaggaaatcaaggcggcgtaccggcggctggcgagggtttgccaccctgacgtggtgccgttggagcgaagggattcctctgcggcagagtttatgaagatccacgccgcataccgcacgctatcggatcctgagaagcgggccagttatgatagaagcttgttccggcggcgccagcggacgctaacaatgtctccgtcggggtattgtggctatggtggtcggaactgggaaacggaccaatgttggtagcgagttgactagtgagtccacaaattggatctagggtgtacttatttaatgctttagagtctttatgtaagcagtaatttttatttcttttacttgcaaaaaggatagacaatagttgaaagac

SEQ ID NO: 122 - protein, 102 aa, Glycine max
  misc_feature: Ceres CLONE ID no.1050475
  misc_feature: Bit score of 125.9 for HMM based on sequences of FIGURE 10.
  misc_feature (6)..(70): Pfam Name: DnaJ Pfam Description: DnaJ domain
  misc_feature: Functional Homolog Of Ceres CLONE ID no. 31309 at SEQ ID NO. 60
MASSATLYQILGVRAVASGEEIKAAYRRLARVCHPDVVPLERRDSSAAEFMKIHAAYRTLSDPEKRASYDRSLFRRRQRTLTMSPSGYCGYGGRNWETDQCW

SEQ ID NO: 123 - DNA, 682 bp, Musa acuminata
  misc_feature: Ceres CLONE ID no.1728904
  misc_feature: Encodes the peptide sequence at SEQ ID NO 124
attcttcaacctcgtttagttgattctgtggctgtgagtcgatgatatcttcaccctctctcgccgctcccagatcccacctccgcttcccaccccgcctgccctcgtcctcctcctgccgccgccgcctcctcctgccccccctttgcgcttcggcgtcgccaccagtccccgcctccgaggcgactctctacgacgtgctcggggtcccgacgggcgccacgggcggcgagatcaaggtggcgtaccggcggctggcgcgagagtgccacccggacgtcgccgcggctaccgagtcgtcggacgagttcatccgactccacgccgcctacgccacgctctctgacccggagaagcgtgccgagtacgaccagcgggtaatggccgccacagcgaacgcagcggcagggaggcggtggtcgccgcggctgtcctactcgtgcaggccgtgccggaggtgggagacggatcagtgctggtaggcagacccggtgttagctgacccgagttgtataggataaagctgtacagattacggccatgatccatttttttttccctttttctttcgttttgttccctctcaacgcagggattgattttaaatcgtttgagtttttgtgtgattaaatggatcttataatctagtataaatttcagtatgaaagatatcatatccttc

SEQ ID NO: 124 - protein, 146 aa, Musa acuminata
  misc_feature: Ceres CLONE ID no.1728904
  misc_feature: Bit score of 124.6 for HMM based on sequences of FIGURE 10.
  misc_feature (49)..(110): Pfam Name: DnaJ Pfam Description: DnaJ domain
  misc_feature: Functional Homolog Of Ceres CLONE ID no. 31309 at SEQ ID NO. 60
MISSPSLAAPRSHLRFPPRLPSSSSCRRRLLLPPLCASASPPVPASEATLYDVLGVPTGATGGEIKVAYRRLARECHPDVAAATESSDEFIRLHAAYATLSDPEKRAEYDQRVMAATANAAAGRRWSPRLSYSCRPCRRWETDQCW

SEQ ID NO: 125 - DNA, 847 bp, Zea mays
  misc_feature: Ceres CLONE ID no.1698538
  misc_feature: Encodes the peptide sequence at SEQ ID NO 126
aaccgtagcccccgaagacacactccaagataccaagaacaccggccacacgcacgcgcgcgcgcaccgacgcacggcaggcgaggccgaggacgaacacacgataaaggaagcaatggctccgtcgctcgcgtcgacggcggggctcccgagctgcgcggcgcggcgcggcggccggtgcgtggcccgccgcgcgtccgcggttgcggctccggcgacggcgacggcgacggcgaggacgcactacgaggtgctcggggtcggggccggcgcgagccggtgcgagatcaaggcggcgtaccggcgcctggcgagggaggtgcacccggactgcggcggccgcggcgacgaggggttcatccgcctgcacgccgcgtacgccacgctcgcggaccccgacgagcgcgcgcgctacgaccgcgccgcggcggtccggagccggatcagggcggcgccgtcggggtccggagcggggttccggccgcggaggtgggagacggaccagtgctggtagcaccgtagcagcagccacgtagacgtagctgcgccggcggtggagtggagtcgccggagcgcgctcggtggtctggtccgtttccagggccagttgcgaccagcgggcccatattgaagacggcccacatgaaaaacggaccgcgatccgggcagcccacaatcacatgagttgggatcgtggactccacaatcacatgagttgggatcgtggactttatgggctgcaggcttcgtaggcctttcgcgccagacttggcgctggatgttgttgtaggccatcatagagctgcacgaagaggcatttttaacatcccaaaaaaaaaaaaaaaaa

SEQ ID NO: 126 - protein, 132 aa, Zea mays
  misc_feature: Ceres CLONE ID no.1698538
  misc_feature: Bit score of 108.8 for HMM based on sequences of FIGURE 10.
  misc_feature (42)..(101): Pfam Name: DnaJ Pfam Description: DnaJ domain
  misc_feature: Functional Homolog Of Ceres CLONE ID no. 31309 at SEQ ID NO. 60
MAPSLASTAGLPSCAARRGGRCVARRASAVAAPATATATARTHYEVLGVGAGASRCEIKAAYRRLAREVHPDCGGRGDEGFIRLHAAYATLADPDERARYDRAAAVRSRIRAAPSGSGAGFRPRRWETDQCW

SEQ ID NO: 127 - protein, 344 aa, Populus balsamifera subsp. trichocarpa
  misc_feature: Ceres ANNOT ID no.1503955
  misc_feature: Bit score of 586.1 for HMM based on sequences of FIGURE 9.
  misc_feature (117)..(331): Pfam Name: Trehalose_PPase Pfam Description: Trehalose-phosphatase
  misc_feature: Functional Homolog Of Ceres SEEDLINE ID no. ME20095 at SEQ ID NO. 1129
MTNQNVVVADTNSGINLAITVHVTNSSIFTTAAQKPPAAPGGYISISRKKLLKNLEISGGARFNAWVNSMRTSSPTHVKSTPSANDDQSSWILHHPSALEMFEQIIDASKGKQIVMFLDYDGTLSPIVDDPDRAFMSKKMRATVRKLARFFPTAIVSGRCRDKVYNFVRLAELYYAGSHGMDIKGPAKGSKYKKVYKELVEKTKTTPGAKVENNKFCLSVHYRCVDEKKWSGLAQVVKSVLKEYPKLRLTQGRKVLEIRPTIKWDKGKALEFLLESLGFANCTDVFPVYIGDDRTDEDAFKVLRERGQGFGILVSKFPKDTSASYSLQEPTQWKRLAFQGQSRV

SEQ ID NO: 128 - DNA, 1083 bp, Populus balsamifera subsp. trichocarpa
  misc_feature: Ceres ANNOT ID no.1473094
  misc_feature: Encodes the peptide sequence at SEQ ID NO 96
atgggatttcagagatcttcctattggcaaaaggtgcagcctggtagtgatctttctacaaaagagacggcaccaaattcaagtcaccctgtaaccaatgaagctgtttctgatgatgcagattacagttcatggatggtggaccatccttctgcattaacctcatttgatcagatgatgaaggatgcaaaggggaagaagatcgtcgtgtttttagactatgacggtactctctcgccgattgtaaatgatcctgaccgcgctttcatgtctgatgagatgcgtgcagcagttcgagaagttgcaaaatactttccaacagctataatcagtggtagaagcagagataagtttatgaggcagagtttgagaatgtcgatggtctctttcgtgcaggtgaaaggatttgtacagttgaataatatatattatgctggaagccatgggatggacatcatggcaccacctaggccggctaggtccagtgatggaaaataccatactgtttcccttgacagaaagggcaatgatgctgtctttcaacctgctcagaaatttttgcctgcaattcaaaagattttgaaagaactggaagaggcaattatgaaaataccaggtgccagagtagagaacaacagattttgtgcctccgtacattttcgacaagttagagaggaggattatgggaccttagaggagaaggtgaagtccatacttaaacactatccagactttcgcttgggttggggtaaaaaggttatggaaatacgaccatcaatagaatgggacaaaggcaatgccctggaatatttactcgatactctagggttaggtaactgcaccgatgttctcccactttacattggagatgacataacagatgaagatgctttcaaggtaattcaaaagagaggccaaggatgtccgatcgttgtcacttccagtcccaaggatactaaagcctcatactccctgtatgaaccatcagaagtgttgacattcttgttgcgtctagcaaggtggaggaaatcctctagttcgagtaggtcagtactatctcaggtttggggtgtgagtggttga

SEQ ID NO: 129 - DNA, 810 bp, Panicum virgatum
  misc_feature: Ceres CLONE ID no.1762328
  misc_feature: Encodes the peptide sequence at SEQ ID NO 130
acgacgacgaatcacgaagcacttgaagaagaaagcaacagcaacacaagcaatggcctcgttcgcatcgacggcggcatccgcttcgacagccgttccgagctgcggcgccggggcccggcgcggcgggcggtgcgtggcccgcgcgtccgcggtggcgatggcgccggcgaggacgcactacgaggtgctcggggtcggggccggggcgagcaggggcgagatcaaggcggcgtaccggcgcctggccagggaggtgcacccggacgccggcggctgcggcggcggcgacgagggcttcatccagctgcacgccgcgtacgccacgctcgcggaccccgacgagcgcgcgcgctacgaccgctcggtggtggcgcggcccgcggcccgcggggcggcgccgccggggttccggccgcggaggtgggagaccgaccagtgctggtagtggtagggacacagccgcgccgcctgcccgtcgcgccgcgtcttgcgctgccacggtgccacctccgccgctcaatcgtggccggcggtgaagtcgccggccgactggccggagcgcgctctgcgcaccggcaggcccatcccatcatgttggggaggaaaggggaaggcccgcgtggcccacttcgcgacccattggggcccaccagaaaacggaaccttgtccacggttgcacgaagagagacatttttcccatctcttgtgtacttacttgatcaccttgtaaatatggataattcctcgtcttggacggtaaacaatccaaagtaggcaagaaacggtaaaaaaaaaaaaaaaaaaaa

SEQ ID NO: 130 - protein, 131 aa, Panicum virgatum
  misc_feature: Ceres CLONE ID no.1762328
  misc_feature: Bit score of 102.9 for HMM based on sequences of FIGURE 10.
  misc_feature (42)..(103): Pfam Name: DnaJ Pfam Description: DnaJ domain
  misc_feature: Functional Homolog Of Ceres CLONE ID no. 31309 at SEQ ID NO. 60
MASFASTAASASTAVPSCGAGARRGGRCVARASAVAMAPARTHYEVLGVGAGASRGEIKAAYRRLAREVHPDAGGCGGGDEGFIQLHAAYATLADPDERARYDRSVVARPAARGAAPPGFRPRRWETDQCW

SEQ ID NO: 131 - DNA, 792 bp, Zea mays
  misc_feature: Ceres CLONE ID no.1590072
  misc_feature: Encodes the peptide sequence at SEQ ID NO 132
agcctcaaccacctgtggtggctgcttctctccccgctcccctcctgcccctttccttcgtcctcagatctgccgattccccgtccctgcgcctccgtctcatgatctctgcgcctctgcgggtgccggcgccgaaggctgccgccgggggttcgttcctgctcggcgcgtcctccgtcgagtccaatcccaatcccaagctcaagcccagcagggtccgctgcgccgccgccgccgccgccacgctgtacgaggtcctgggcctgcgcgccggcgcgacgggccgggagatcaaggccgcgtaccggcgcctggcgcgggagcggcacccggacgtggcgcacgcgcccggggccgccgccgagttcgcccgcctgcacgacgcctacgccacgctctccgacccggacagccgcgcgcgctacgacggcggcggcgccgcgcccgcggcggcggtggcgaggcgcccctggagcggcgccgtctacggccggccccgacgccgcacatgggagacggaccagtgctggtagtagagagtagagaggcacagccaagagccccacgcgcttcttgtctgtctgtagaatagttagacctcctgccgccagccatgcggccatggcggctcaccttggactttttttttggtttcggtggccatccatgtagcgtgatttttcgttttccttcctccacttgcccttgtacctgtgtgctgtggtcttgacttcttgagatgtaaatactagtacttgatgagatggttggaggagtaaaaaaaaaaaaaaa

SEQ ID NO: 132 - protein, 143 aa, Zea mays
  misc_feature: Ceres CLONE ID no.1590072
  misc_feature: Bit score of 98.0 for HMM based on sequences of FIGURE 10.
  misc_feature (48)..(109): Pfam Name: DnaJ Pfam Description: DnaJ domain
  misc_feature: Functional Homolog Of Ceres CLONE ID no. 31309 at SEQ ID NO. 60
MISAPLRVPAPKAAAGGSFLLGASSVESNPNPKLKPSRVRCAAAAAATLYEVLGLRAGATGREIKAAYRRLARERHPDVAHAPGAAAEFARLHDAYATLSDPDSRARYDGGGAAPAAAVARRPWSGAVYGRPRRRTWETDQCW

SEQ ID NO: 133 - DNA, 751 bp, Glycine max
  misc_feature: Ceres CLONE ID no.471593
  misc_feature: Encodes the peptide sequence at SEQ ID NO 134
gacgatagaaattcaatccacatgattttgaatatgagcatgttaccaatctttgttggccttacattttcattttttataagcactctagtctagtgccattcaagtgttctataaaatggcactccccatatcattctccttaaccctaatccagtatatgccaaattttctagaaaaattgtttccactctacaactgaaaacagagaactctgttcttgttctcaaaaaacaaaaaaaatggcttccctctatgacgtgcttggaatttcagtgggtgcaagctgcatcgaaataaaggctgcttacagaaagctggcaagaacacaccatcctgatgttgtggccatggatcagaaggaaagctcagcgaaccaattcatgatgatccattcagcttactcaactttgtctgacccagagaagcgagcacaatatgatagagaaatctatagatacagaagatcagcaaatatagcaggaagaaatcagacattttcctatgctggaagtggaaggaaatgggaaacagaccaatgttggtaacagattgtatagtcatgtacattattattaaccmctttgttctcttttttcttcttctctttttctaagtttttgttatgactatgtcattcatttatgttttccttcttcacaataccatcctaagactgtgtagttccagattacttactagatctcctgattcaagcttcgtgtaattttaatgccatgttgatttggtc

SEQ ID NO: 134 - protein, 101 aa, Glycine max
  misc_feature: Ceres CLONE ID no.471593
  misc_feature: Bit score of 97.1 for HMM based on sequences of FIGURE 10.
  misc_feature (3)..(67): Pfam Name: DnaJ Pfam Description: DnaJ domain
  misc_feature: Functional Homolog Of Ceres CLONE ID no. 31309 at SEQ ID NO. 60
MASLYDVLGISVGASCIEIKAAYRKLARTHHPDVVAMDQKESSANQFMMIHSAYSTLSDPEKRAQYDREIYRYRRSANIAGRNQTFSYAGSGRKWETDQCW

SEQ ID NO: 135 - DNA, 891 bp, Triticum aestivum
  misc_feature: Ceres CLONE ID no.1031667
  misc_feature: Encodes the peptide sequence at SEQ ID NO 136
ttcgacgaggacgaacaacagtgcaacaaagaagtactctgcttttggatcaagaactcgagaacagagaggagaatcgatggccacgttcgcgacgtcaacggcggcagtgatgggatcggctcgccctggccgggtggccgggcctcggcggtgcgtggtggcgcgcgcgtccgccatgatggcggcaccggcgccggtggcggccgggaggacgcactacgaggtgctcggtgtgagtgccagggcgagcaggggggagatcaaggaggcgtaccggcgtctggccagggaggtgcacccggacgctgctggtggcggcggcgacgaggggttcatccggcttcacgcggcctacgccacgctggccgaccctgacgagcgcgcgcgctacgaccgggacgtggcctgccgcaccgccgggatgatgatgcggcggccggccgcggccgggccggcgttccggcggaggacgtgggagaccgaccagtgctggtaggaggggcggacacacgacgacacgtggttgctcagttctcccgttcccggccggcggccgtctggttcgatcaggcacggcgtcgaggttgtcgatggtcgccaggaaggaaaccgcgtcgtctgacgtgcgccgtccgatcagtgttggccggtccagatctaacgacgcggatgcgggagagctgtgaactgcgacgcgacgagaggcattttttgaagatctcttgcgttcgaccagcaaatgattagctactgcctgtaaattaatggcctgggaaatgttatagctctctgtggttatagaaggaaatatttaccccctccatgtcatagttttttgtttgccaagtaaggattaaagggttactaacttcaaaaaaaaaaaaaaaa

SEQ ID NO: 136 - protein, 139 aa, Triticum aestivum
  misc_feature: Ceres CLONE ID no.1031667
  misc_feature: Bit score of 97.1 for HMM based on sequences of FIGURE 10.
  misc_feature (46)..(106): Pfam Name: DnaJ Pfam Description: DnaJ domain
  misc_feature: Functional Homolog Of Ceres CLONE ID no. 31309 at SEQ ID NO. 60
MATFATSTAAVMGSARPGRVAGPRRCVVARASAMMAAPAPVAAGRTHYEVLGVSARASRGEIKEAYRRLAREVHPDAAGGGGDEGFIRLHAAYATLADPDERARYDRDVACRTAGMMMRRPAAAGPAFRRRTWETDQCW

SEQ ID NO: 137 - DNA, 1176 bp, Panicum virgatum
  misc_feature: Ceres CLONE ID no.1826085
  misc_feature: Encodes the peptide sequence at SEQ ID NO 138
ggcactccaccctcggcgacgacggatcacgaaacacttgaagaagaaagcagcaggcagcaacgcaatggcttggttcgcatcgacggcagccgttccgagctgcggcgccggggcccggcgcggcggccggtgcggggcccgcgcgtccgcggtggcgatggcgccggggacggcgaggacgcactacgaggtgctcggggtcggggccggggcgagcaggggcgagatcaaggcggcgtaccggcgcctggccagggaggtgcacccggacgccggcggctgcggcggcgacgagggcttcatccagctgcacgccgcctacgccacgctcgcggaccccgacgagcgcgcgcggtacgaccgctcggtggcgcggcccgcggcccgcggggcggcgccggcggggttccggccgcggaggtgggagaccgaccagtgctggtagggacacagctgcgcctgcccgttgcgccgcgacctacgctgccacccacctccgccgctccatccgtggccggcggtgaagtcgccggccggccggcccatcccatcatgttggtggaggaaaggggaagggcccacgtggcccacttcgacagcgggtcgcgactattctccgcgacccactgggccgatccgcgatcagcccccggcccacgagttggatcggggacgacgcggcggcgcggcggcggaggtcactgcactgacctgaccagggcggaggatgggcccagggagcaggggagctcctctctcttcgtagcttgtccccccctgttacacgaagagaggcatttttataacatctcttgtgtacttacttgatcaccttgtaaatatggataatctgtgtgaatataaattctcgtcttggacggtaaactatccaagtaggcaagaaacggtaataatttccaagggtttcaaaagtgattgtgaggattttggttaaagacaggcaagtcaaccaatgctaatcctgcctgtttagcagtcatgttcttgctctcgtggctctgcacacttgttgctcgctcgcgctcactcgagagttcagtagctgtgacatgacaagggtcccaagctagcagaacaccaccacaagttctctcacaaggcaggagtcgctgccccaaaaaattcagttgccaaaaaaaaaaaaaaaaaaaa

SEQ ID NO: 138 - protein, 126 aa, Panicum virgatum
  misc_feature: Ceres CLONE ID no.1826085
  misc_feature: Bit score of 96.9 for HMM based on sequences of FIGURE 10.
  misc_feature (39)..(99): Pfam Name: DnaJ Pfam Description: DnaJ domain
  misc_feature: Functional Homolog Of Ceres CLONE ID no. 31309 at SEQ ID NO. 60
MAWFASTAAVPSCGAGARRGGRCGARASAVAMAPGTARTHYEVLGVGAGASRGEIKAAYRRLAREVHPDAGGCGGDEGFIQLHAAYATLADPDERARYDRSVARPAARGAAPAGFRPRRWETDQCW

SEQ ID NO: 139 - protein, 339 aa, Populus balsamifera subsp. trichocarpa
  misc_feature: Ceres ANNOT ID no.1526501
  misc_feature: Bit score of 478.0 for HMM based on sequences of FIGURE 9.
  misc_feature (71)..(308): Pfam Name: Trehalose_PPase Pfam Description: Trehalose-phosphatase
  misc_feature: Functional Homolog Of Ceres SEEDLINE ID no. ME20095 at SEQ ID NO. 1129
MGFQRSSYWQKVQPGSDLSTKETAPNSSHPVTNEAVSDDADYSSWMVDHPSALTSFDQMMKDAKGKKIVVFLDYDGTLSPIVNDPDRAFMSDEMRAAVREVAKYFPTAIISGRSRDKLNNIYYAGSHGMDIMAPPRPARSSDGKYHTVSLDRKGNDAVFQPAQKFLPAIQKILKELEEAIMKIPGARVENNRFCASVHFRQVREEDYGTLEEKVKSILKHYPDFRLGWGKKVMEIRPSIEWDKGNALEYLLDTLGLGNCTDVLPLYIGDDITDEDAFKVIQKRGQGCPIVVTSSPKDTKASYSLYEPSEVLTFLLRLARWRKSSSSSRSVLSQVWGVSG

SEQ ID NO: 140 - DNA, 1035 bp, Populus balsamifera subsp. trichocarpa
  misc_feature: Ceres ANNOT ID no.1503955
  misc_feature: Encodes the peptide sequence at SEQ ID NO 127
atgacaaaccaaaatgtggtagtggctgatacaaactctggaatcaacttggcaatcacagtgcatgtaacaaattcctctatcttcaccacggccgcgcagaagcctccggcggctcctggtggttacatctctatttccagaaagaaacttttaaagaatcttgaaatcagtggaggagcaagatttaatgcttgggttaattccatgagaacctcttctcctactcatgtcaagtccacaccttctgctaatgacgaccaaagctcatggattcttcaccacccatcagcactggagatgtttgagcagataattgatgcctccaaaggaaagcaaatagttatgttcttggactatgatggcacactttctcctatcgttgatgacccagatagagctttcatgtccaagaagatgagagcaacagtgagaaagcttgcgagattttttcctactgcaatagtgagtgggagatgcagagacaaggtgtataactttgtacggttagcagaactgtactatgctggaagccatggcatggacatcaaaggaccagccaaaggcagcaaatacaagaaagtttacaaagaactggtagagaaaactaaaacaactccaggggccaaggtggaaaataacaaattctgtctctctgtgcactatcgctgcgttgatgagaagaaatggagtggactggctcaagtagttaagtcagtgttgaaggagtacccaaagcttcgacttactcaaggaagaaaggttttagaaatccgccctaccattaaatgggacaaaggaaaggctcttgaatttttgttagagtctcttggattcgccaattgtactgatgtttttcctgtttacattggagatgatagaacagacgaggatgcatttaaggtgctgagagagagaggacaaggttttggtatcttggtctctaaattccccaaggacactagtgcatcttattccctacaagaacccacccagtggaaacggctagcctttcaagggcagtcaagggtttaa

SEQ ID NO: 141 - DNA, 817 bp, Zea mays
  misc_feature: Ceres CLONE ID no.373932
  misc_feature: Encodes the peptide sequence at SEQ ID NO 142
aacgccaacgcctcaaccacctgtggtggcttctcctctccccgctccccccctgccccttcccttcgtcctcagatccgccgatcccccgcccctgcgcctccgtctcatgatctctgcgcctctgcgggtgccggcgccgaaggctgccgccgggggttcgttcctgctcggcgcgtcctccgtcgagtccaatcccaatcccaagcccagcaggatccgctgcgccgccgccacgctgtacgaggtcctgggcctgcgcgccggcgcgacgggccgggagatcaaggccgcgtacaggcgcctggcgcgggagcggcacccggacgtggcgcacgcgcccggggccgccgccgagttcgcccgcctgcacgacgcctacgccacgctctccgacccggacagccgcgcgcgctacgacggcggcggcgccgcgcccgcggcggcggtggcgaggcgcccctggagcggcgccgtctacggccggccccgacgccgcacatgggagacggaccagtgctggtagtagagagtagagaggcacagccaagagccccacgcgcttcttgtctgtctgtagaatagttagacctcctgccgccagccatgcggccatggcggctcaccttggactttttttttggtttcggtggccatccatgtagcgtgatttttcgttttccttcctccacttgcccttgtacctgtgtgctgtggtcttgacttcttgagatgtaaatactagtacttgatgagatggttggaggagtagccgccctgcctctgttaattctaaataatccaagctgttctctcc

SEQ ID NO: 142 - protein, 138 aa, Zea mays
  misc_feature: Ceres CLONE ID no.373932
  misc_feature: Bit score of 93.6 for HMM based on sequences of FIGURE 10.
  misc_feature (43)..(104): Pfam Name: DnaJ Pfam Description: DnaJ domain
  misc_feature: Functional Homolog Of Ceres CLONE ID no. 31309 at SEQ ID NO. 60
MISAPLRVPAPKAAAGGSFLLGASSVESNPNPKPSRIRCAAATLYEVLGLRAGATGREIKAAYRRLARERHPDVAHAPGAAAEFARLHDAYATLSDPDSRARYDGGGAAPAAAVARRPWSGAVYGRPRRRTWETDQCW

SEQ ID NO: 143 - DNA, 594 bp, Gossypium hirsutum
  misc_feature: Ceres CLONE ID no.1797836
  misc_feature: Encodes the peptide sequence at SEQ ID NO 144
accttaaaacccttttgtttatcaatggcttcatctgtctcattgtacgaggttcttggtgtaccagtgagtgcaaacggtagtgaaatcaaggcagcttatagaagacttgcgagaacgtggcaccctgatgttgtgtctgtaaaccagaaagaaatgtctgctgatcggttcatgagaatccatgcagcgtattccacgttgtcggatcctaatcaacgtgcggattatgataggaatcttagacggtggaaccgtccctttacgactatggaagcaactgcgacggcggtggcttcgtatgggttttctagttatggtgctaataggaattgggagaccgatcagtgctggtagttaattatatgtattttttttatgttcgttttatatccatgaaatttaatctttttagaatttatagttatctctaacttttattcttaaaaatgtaatatatttttccattgtacctaacataatcaatgtcgtattccattgtgacaagtcccatggtctttattgtaaattaatcaggagcaaatccagaggctggcagggcccaacccctttaaaatgaaaattttatcattc

SEQ ID NO: 144 - protein, 110 aa, Gossypium hirsutum
  misc_feature: Ceres CLONE ID no.1797836
  misc_feature: Bit score of 89.8 for HMM based on sequences of FIGURE 10.
  misc_feature (6)..(70): Pfam Name: DnaJ Pfam Description: DnaJ domain
  misc_feature: Functional Homolog Of Ceres CLONE ID no. 31309 at SEQ ID NO. 60
MASSVSLYEVLGVPVSANGSEIKAAYRRLARTWHPDVVSVNQKEMSADRFMRIHAAYSTLSDPNQRADYDRNLRRWNRPFTTMEATATAVASYGFSSYGANRNWETDQCW

SEQ ID NO: 145 - DNA, 489 bp, Brassica napus
  misc_feature: Ceres CLONE ID no.1102774
  misc_feature: Encodes the peptide sequence at SEQ ID NO 146
aatctctcttcatttccctctctcgaacaagaagacaacaactcaaaacgcagagaagatctccagaacgacaccgtttcgtagcaaagatgctttcktcgtctccaacctccttcactcatccattcctctccacgtctccgcctctctcccccatatctccgccgtctcgctcacctcgcctcccgcctcctctcgtctccgcctcttgctcctacacctgcacggaggatccgccgaggctgcaccagatcccgcggcgaacgacgccggcgaacgcttcgctctacgagattctagaggttcctcgcggcgcgacgagccaggatatcaaatcggcttaccggaggttggctaggatctgccaccccgacgtggcggcgggaaccgatcggagtaactcttcggcggatgagttcatgaagatccacgcggcgtactgtacgctctctgatcctgacaaacgctctgtttacgatcggaggatgc

SEQ ID NO: 146 - protein, 133 aa, Brassica napus
  misc_feature: Ceres CLONE ID no.1102774
  misc_feature: Bit score of 82.3 for HMM based on sequences of FIGURE 10.
  misc_feature (65)..(130): Pfam Name: DnaJ Pfam Description: DnaJ domain
  misc_feature: Functional Homolog Of Ceres CLONE ID no. 31309 at SEQ ID NO. 60
  misc_feature (3)..(3): Xaa is any aa, unknown, or other
MLXSSPTSFTHPFLSTSPPLSPISPPSRSPRLPPPLVSASCSYTCTEDPPRLHQIPRRTTPANASLYEILEVPRGATSQDIKSAYRRLARICHPDVAAGTDRSNSSADEFMKIHAAYCTLSDPDKRSVYDRRM

SEQ ID NO: 147 - DNA, 677 bp, Triticum aestivum
  misc_feature: Ceres CLONE ID no.842287
  misc_feature: Encodes the peptide sequence at SEQ ID NO 148
aacccgaagtgctcaactcccagctcactcgaccccccagctcccaactctaccccgaccaagcgaagcgagccgagaagatcttagccaatggcgggagcagtgcctctggcgccgccgatggtggccgcggcgaggccggcggcgggctcgctctacgaagcgctgcgcgtgggccgcgcggcgacgcaggtggagatcaggaccgcgtaccgctccatggccaagcgcctccaccccgacgtcgcctcctgcggccacgggggccccgaggcgttcctggagatccggagggcgtacgagacgctgtcggacccggcggccagggcgcgctacgactgctcgctcggggtgttccgcggtgggggcgccggcggcgtgatgcgggtgcggaggtgggagacggaccagtgctggtgaagtggtgatccaccaagccatggtatgggcaatagcatcgctcccaggaagtcaggaacgtggatgagctgcaacggcctgtgttggtgtcctcggcgtagttagtgctaagttagtggagaggttgtgatgtgggtccagccgtcggtccccctatgcagccggccccactttttggtctttttggggccactcttggtcctggtgatgtagcttttgtgaatatatattcaagcttgctactgttcagctgcttt

SEQ ID NO: 148 - protein, 109 aa, Triticum aestivum
  misc_feature: Ceres CLONE ID no.842287
  misc_feature: Bit score of 73.5 for HMM based on sequences of FIGURE 10.
  misc_feature (21)..(83): Pfam Name: DnaJ Pfam Description: DnaJ domain
  misc_feature: Functional Homolog Of Ceres CLONE ID no. 31309 at SEQ ID NO. 60
MAGAVPLAPPMVAAARPAAGSLYEALRVGRAATQVEIRTAYRSMAKRLHPDVASCGHGGPEAFLEIRRAYETLSDPAARARYDCSLGVFRGGGAGGVMRVRRWETDQCW

SEQ ID NO: 149 - DNA, 440 bp, Triticum aestivum
  misc_feature: Ceres CLONE ID no.568205
  misc_feature: Encodes the peptide sequence at SEQ ID NO 150
attcccgtctcccctcacctgcctacttttcctctgctcccccgactcatccgtccgtctctcccgttctctcttctcagatttgtggattcgtgtgatgatttcaccgcccccggtgatgcaatcctccgcggcgaggcccgccttggccgggttccgccatgccgccgcctgctccagctcccgccggacggtccggtgcgcggtggccgtcgcgtcggcggcgccggccgggaggtgcacgctgtacgaggtgctcgggctgcgggccggcgccacgcgcggcgagatcaaggccgcctaccggcgactggctcgggagcggcacccggacgtggccggcgcggccggcgacgacttcatccgcctgcacgacgcctacgccacgctctccgacccggacgcccgcgcgcgctacgaccgcgacgtcgtcgtgcagg

SEQ ID NO: 150 - protein, 146 aa, Triticum aestivum
  misc_feature: Ceres CLONE ID no.568205
  misc_feature: Bit score of 56.3 for HMM based on sequences of FIGURE 10.
  misc_feature (81)..(140): Pfam Name: DnaJ Pfam Description: DnaJ domain
  misc_feature: Functional Homolog Of Ceres CLONE ID no. 31309 at SEQ ID NO. 60
FPSPLTCLLFLCSPDSSVRLSRSLFSDLWIRVMISPPPVMQSSAARPALAGFRHAAACSSSRRTVRCAVAVASAAPAGRCTLYEVLGLRAGATRGEIKAAYRRLARERHPDVAGAAGDDFIRLHDAYATLSDPDARARYDRDVVVQ

SEQ ID NO: 151 - DNA, 717 bp, Glycine max
  misc_feature: Ceres CLONE ID no.1075133
  misc_feature: Encodes the peptide sequence at SEQ ID NO 152
gtgtgattcatatctgcttctcagacgaactctctctgcttaatccaaattttaacgcgttctttcgaatttgcccctccaattttaatttaattacgtaaatgtccggaactctaatctacttaggcgttaactcccttcgatcctcgccgggaaatagccttcgtcaaccgaagccaaccagactccacaacggaaacgcgcggctctccaccggagctacgtcgtttagagcttcggcagcgcagactctcaacgccgaaccagccgtaacggaatccgttcgccggcgagcgtcgaacctctacgaactgctgagagtggacgaaacggcgtcgttgacggagattaagacggcgtaccggagcttagctaaggttcaccatccggacgcgtcgtcggaatcggacggacgagatttcatggagattcacaaagcttacgcgacgctggcggatccgacgacgagagcgatctacgattcgacgctgggagcaagagggagacgagtgcacgctggagcgatggggaggacgagtcgggtttacccgacgacccggagatgggagacggatcagtgttggtagtttagtctttaggtttccgattacttttttttactcaatttccccttttcattattttttttactaaggggtaaataagttttttttaccacagatggtttaatgaatagagagatgtacatttttgggg

SEQ ID NO: 152 - protein, 161 aa, Glycine max
  misc_feature: Ceres CLONE ID no.1075133
  misc_feature: Bit score of 387.6 for HMM based on sequences of FIGURE 10.
  misc_feature (67)..(127): Pfam Name: DnaJ Pfam Description: DnaJ domain
  misc_feature: Functional Homolog Of Ceres CLONE ID no. 31309 at SEQ ID NO. 60
MSGTLIYLGVNSLRSSPGNSLRQPKPTRLHNGNARLSTGATSFRASAAQTLNAEPAVTESVRRRASNLYELLRVDETASLTEIKTAYRSLAKVHHPDASSESDGRDFMEIHKAYATLADPTTRAIYDSTLGARGRRVHAGAMGRTSRVYPTTRRWETDQCW

SEQ ID NO: 153 - DNA, 480 bp, Sorghum bicolor
  misc_feature: Ceres ANNOT ID no.6108997
  misc_feature: Encodes the peptide sequence at SEQ ID NO 154
atgatctccccgcgccccgcgctctcccccagcttcctcgccttccggccgggctccctctccccggccgcgtcgccgccgccgtccccgcgcctccaccacgcgccgccgcccctctccgcctccatctcctccaccgtcgctgccaccgcggcgccgggccacgcggcggcggccagctccttctacgacgtcctcggcctccgccccggggccagtgcgcgggagatcaaggccgcgtaccgtcgcctggcgctcgccgtccacccggacgccgccgccgccgcctcgtccgccgaggacttcatccgcgtccacgcggcctactccacgctctccgaccccgacaagcgcgccgactacgaccgccgcctcctcctctccgccgccgcgagacggcgcaccgccgctctcggacgctcgccctcgttcccagcgcaccgttcccgccggacctgggagactgaccagtgctggtga

SEQ ID NO: 154 - protein, 159 aa, Sorghum bicolor
  misc_feature: Ceres ANNOT ID no.6108997
  misc_feature: Bit score of 264.8 for HMM based on sequences of FIGURE 10.
  misc_feature (61)..(122): Pfam Name: DnaJ Pfam Description: DnaJ domain
  misc_feature: Functional Homolog Of Ceres CLONE ID no. 31309 at SEQ ID NO. 60
MISPRPALSPSFLAFRPGSLSPAASPPPSPRLHHAPPPLSASISSTVAATAAPGHAAAASSFYDVLGLRPGASAREIKAAYRRLALAVHPDAAAAASSAEDFIRVHAAYSTLSDPDKRADYDRRLLLSAAARRRTAALGRSPSFPAHRSRRTWETDQCW

SEQ ID NO: 155 - DNA, 414 bp, Sorghum bicolor
  misc_feature: Ceres ANNOT ID no.6023609
  misc_feature: Encodes the peptide sequence at SEQ ID NO 156
atggcttcgtcgctcgcgtcgacgccggtgttccccagctgcggcgcgcggcgcggcgcccggtgcgtggcgcgcgcgtccgcgtccgcggtggcggtggcggtggcgtctccgtcggcggcgaggacgcactacgaggtgctcggggtcggggccggcgccagcaggtgcgagatcaaggcggcgtaccggcgcctggcgagggaggtgcacccggacgccggcggccgcggcgacgaagggttcatccgcctgcacgacgcgtacgccacgctcgcggaccccgacgagcgcgcgcgctacgaccgcgccgtggccgtcgccgcgccggtccggaacggcagctgggccgcgccgtcagggtccgggtcggggttccggccgcggaggtgggagaccgaccagtgctggtag

SEQ ID NO: 156 - protein, 137 aa, Sorghum bicolor
  misc_feature: Ceres ANNOT ID no.6023609
  misc_feature: Bit score of 102.6 for HMM based on sequences of FIGURE 10.
  misc_feature (43)..(102): Pfam Name: DnaJ Pfam Description: DnaJ domain
  misc_feature: Functional Homolog Of Ceres CLONE ID no. 31309 at SEQ ID NO. 60
MASSLASTPVFPSCGARRGARCVARASASAVAVAVASPSAARTHYEVLGVGAGASRCEIKAAYRRLAREVHPDAGGRGDEGFIRLHDAYATLADPDERARYDRAVAVAAPVRNGSWAAPSGSGSGFRPRRWETDQCW

SEQ ID NO: 157 - DNA, 312 bp, Sorghum bicolor
  misc_feature: Ceres ANNOT ID no.6017906
  misc_feature: Encodes the peptide sequence at SEQ ID NO 158
atggcgggagcggtgcccctggccacggcgccggcactcgcggcggcggggagcctgtacgaggcgctgcgggtaggccgcgccgcgacgcaggtggagatcaaggtcgcctaccgcgccatggccaagcgcctccaccccgacacctcccgctcgtcccgaactgcggcggcgttcctggagatccagcgcgcctacgagacgctgtcgaacccggacgcccgagcgcactacgaccgctcgctcggcccgcggccgggcgccggcggcggcatgcgggtgcgtcggtgggaaacggaccagtgctggtag

SEQ ID NO: 158 - protein, 103 aa, Sorghum bicolor
  misc_feature: Ceres ANNOT ID no.6017906
  misc_feature: Bit score of 75.4 for HMM based on sequences of FIGURE 10.
  misc_feature (18)..(79): Pfam Name: DnaJ Pfam Description: DnaJ domain
  misc_feature: Functional Homolog Of Ceres CLONE ID no. 31309 at SEQ ID NO. 60
MAGAVPLATAPALAAAGSLYEALRVGRAATQVEIKVAYRAMAKRLHPDTSRSSRTAAAFLEIQRAYETLSNPDARAHYDRSLGPRPGAGGGMRVRRWETDQCW

SEQ ID NO: 159 - DNA, 1102 bp, Arabidopsis thaliana
  misc_feature: Ceres CLONE ID no.41543
  misc_feature: Expected Sequence
  misc_feature: Encodes the peptide sequence at SEQ ID NO. 160
atatgcagagagaaaaagaagccaattggttctctctctctctctctctctctctgattgattgatccagcgattcgtctggctggctcggtttccgcgggaaaaccttcttcttcgttgaccttacacgagttttgttgattcggcagggggatcgacgacggagatggcgattctgtacgccctcgtggctcgtggcacggtggttctttctgagttcaccgccacctctacgaatgcgagcaccatcgccaaacagatcctcgagaaggtccctggagacaacgacagcaacgtctcctactctcaggatcgttacgtcttccacgttaaacgcaccgatggcctcaccgttctctgtatggccgaagaaaccgccggaaggagaattccttttgcctttttggaggatattcaccagagattcgtacggacttatggcagggctgttcatacagcactagcttatgcaatgaatgaggaattctctagagttctcagtcagcagattgactattactctaatgatcctaatgccgataggattaatcgtattaagggtgaaatgaatcaggtgcggggtgtcatgatagaaaacattgacaaagtcctagatagaggtgaacgtttggagcttcttgtcgataaaaccgccaatatgcaggggaatacattccggttcagaaagcaagctcgtcgttttagaagcaacgtctggtggagaaactgcaagctcacggtcctcttaatactactactactggtgatcatatacattgcagtggcctttctctgccacggacctactctaccatcttgcatttaagtgcatctgtctcttaaggaatccatcccgattctgcgcgttgccacgactttttatctcctcatctgattgtaaaccttgtgttttcctgagcattttcatgtggcttaaaaagcttatgtttccaactcacgtatatgaaaaagtatacttatttatagagcaatgtaaaagctcattgctttgcgaagtgtgtgaatctttgttgacatcatgttctataaattacatacatagtggaaaagtgaacaggcttgctttgtctgatatgttcat

SEQ ID NO: 160 - protein, 219 aa, Arabidopsis thaliana
  misc_feature: Ceres CLONE ID no.41543
  misc_feature: Bit score of 646.6 for HMM based on sequences of FIGURE 13.
  misc_feature (123)..(211): Pfam Name: Synaptobrevin Pfam Description: Synaptobrevin
MAILYALVARGTVVLSEFTATSTNASTIAKQILEKVPGDNDSNVSYSQDRYVFHVKRTDGLTVLCMAEETAGRRIPFAFLEDIHQRFVRTYGRAVHTALAYAMNEEFSRVLSQQIDYYSNDPNADRINRIKGEMNQVRGVMIENIDKVLDRGERLELLVDKTANMQGNTFRFRKQARRFRSNVWWRNCKLTVLLILLLLVIIYIAVAFLCHGPTLPSCI

SEQ ID NO: 161 - DNA, 1001 bp, Gossypium hirsutum
  misc_feature: Ceres CLONE ID no.1837065
  misc_feature: Encodes the peptide sequence at SEQ ID NO 162
acatctgtcaaagcgatatagggagagtttcgactttagatggcgatattgtacgcgctggtcgcgcgtggatcggtgatgctggcggagttcacggcggcgtcgactaacgccagcgcgatcgccaggcaaattctagacaagataccgggtgacaacgacattaacgtttcgtattcacaagatcgatacatcttccacgttaaacgcaccgatggactcaccgttctttgtatggctgatgaaagtgccggaaggcgaattccttttgcgtttcttgaagacattcatcagagattcgttaggacttatggccgagcaatattttcagcccttccttatggcatgaatgatgaattttcgagggttttgagccagcaaatggaatattactcgagcgatcctaatgctgataggataaatcgactaaaaggtgaaatgggtcaggtgcgaaacgttatgatagagaacatcgacaaagtcttagagagaggtgatcgcttggaattgctggttgataaaactgctaatatgcaaggaaatacctttcgcttccgaaagcaaactcgccgacttagaaacacagtatggtggagaaatgtcaagcttacgggtgctctgataatcctcatcctaattattatttatgttgtgctggcttttgtttgccacggtatcacgctacctacttgcataaaatgatgtcaacaggtttgagatttgaacgcctttcgcactctcatgctcccttgccgttacttttgtttccatttccgttcgtatggtttttaatctctgcttgggggtagcatatctgggatctttctgtttcaacttcccctgcagtgagttgtatttacattttacttattcaatgtgaaagagtctccatgtaactttaaattggttttcaaagacatggcttgatggcattaaaatttatgtaaaagttacatacattatatatatatcttatttgcgaaaaaaaaaaaaaaaaaaaa

SEQ ID NO: 162 - protein, 220 aa, Gossypium hirsutum
  misc_feature: Ceres CLONE ID no.1837065
  misc_feature: Bit score of 654.0 for HMM based on sequences of FIGURE 13.
  misc_feature (123)..(211): Pfam Name: Synaptobrevin Pfam Description: Synaptobrevin
  misc_feature: Functional Homolog Of Ceres CLONE ID no. 41543 at SEQ ID NO. 160
MAILYALVARGSVMLAEFTAASTNASAIARQILDKIPGDNDINVSYSQDRYIFHVKRTDGLTVLCMADESAGRRIPFAFLEDIHQRFVRTYGRAIFSALPYGMNDEFSRVLSQQMEYYSSDPNADRINRLKGEMGQVRNVMIENIDKVLERGDRLELLVDKTANMQGNTFRFRKQTRRLRNTVWWRNVKLTGALIILILIIIYVVLAFVCHGITLPTCIK

SEQ ID NO: 163 - DNA, 1292 bp, Gossypium hirsutum
  misc_feature: Ceres CLONE ID no.1895763
  misc_feature: Encodes the peptide sequence at SEQ ID NO 164
aacgaattaaccaatttttttaaaactcactgatttttaattgaagtcaatttcggtttttttttccctggattttcttttataaaataattatatttgctcaattaatttttattttccagcaggcaaaattccctgtttggttcaactcgtcccaaaacaaagttcttttaagactaatccccaaaaatttcgcataaaacacctcttcgttgctgcccccgccatctaatttagctttgaaatcagtaaaaaaaagaagaaggaaggttctcgatggcgattctttacgccgtggtggctcgaggcacggtggttctagcggagtttagtgccgtaacggggaacaccggtgcggtggcacgacggatcctcgagaaacttccgccagaagccgattcaagactctgtttatcgcaggatcgttatatctttcatatacttagatcggatagcctcactttcctctgtatggctaatgatacctttggaaggagagttccattttcatacttggaggatattcacatgaggttcatgaaaaattatggtagagtggctcgttatgcaccggcatacgcgatgaatgatgagttctcacgggtattgcatcaacaaatggagtttttctccagtagtccaagtgcagatactctcaatcgtgttagaggtgaagtgggtgagatacgttcaatcatggtggaaaacattgagaagatactcgagagaggtgacaggattgagcttcttgttgacaaaactgctacaatgcaggatgatgcttttcacttcaagaaacagtctaaacgccttcgtcaagcactttggatgaaaaatgccaaactcttggccatgctaacatgcttgatcgtgcttatactctacctaataattgctgcttgctgtggtggtatcactctaccatcatgcagatcctgagtgacgcactcactcgtttaaattcctctactaaggtatgcatctcaaggattattttatgcaagtttgttccaatagttcatctgttttgagttcggttttgaggaatatttgtaaacatagtgtttattacgatactgctctagaatcccagcaaaatatctatatagttcacaactcttcctgcacctcatcacctagatattataatcttggaagaatgagttgccattaaagttgcggtggatcatctttgtattctgtaaatgcatggaatatatgtagtagtgaattttttatttgttttcagggttcaaataaatgcttttttggaaaaaaaaaaaaaaaaaaaa

SEQ ID NO: 164 - protein, 220 aa, Gossypium hirsutum
  misc_feature: Ceres CLONE ID no.1895763
  misc_feature: Bit score of 550.1 for HMM based on sequences of FIGURE 13.
  misc_feature (123)..(211): Pfam Name: Synaptobrevin Pfam Description: Synaptobrevin
  misc_feature: Functional Homolog Of Ceres CLONE ID no. 41543 at SEQ ID NO. 160
MAILYAVVARGTVVLAEFSAVTGNTGAVARRILEKLPPEADSRLCLSQDRYIFHILRSDSLTFLCMANDTFGRRVPFSYLEDIHMRFMKNYGRVARYAPAYAMNDEFSRVLHQQMEFFSSSPSADTLNRVRGEVGEIRSIMVENIEKILERGDRIELLVDKTATMQDDAFHFKKQSKRLRQALWMKNAKLLAMLTCLIVLILYLIIAACCGGITLPSCRS

SEQ ID NO: 165 - DNA, 1070 bp, Gossypium hirsutum
  misc_feature: Ceres CLONE ID no.1850460
  misc_feature: Encodes the peptide sequence at SEQ ID NO 166
atttttctatatcttctcggatcccatcgaccctccgaagtcatctctcactgatttttcaacctttgcggatttgaatctttgcttgagggttagggttttgagagatggggcaacagtctttgatctacagcttcgtggcgcgtggaactgtgatactcgccgagtacaccgagttcaccggtaatttcaccggtatcgccgctcaatgtctccagaaactccctgcttctaacaacaagttcacctatacctgcgatggccataccttcaattacctcgttgaagatggattcacctactgtgtagttgctgttgaatctgctggcaggcaagttccaattgcatttctggaaagagttaaggaagacttcaacaagagatatggtggaggaaaggctgcaactgctacggccaaaagtctgaatagagaatttgggtccaaattgaaggagcatatgcagtactgtgtggaccatcctgaagaaatcagcaaacttgctaaagtgaaggctcaggtttctgaagtcaagggtgttatgatggaaaacatcgagaaggtccttgaccgtggtgagaagattgagttgctggtggataaaactgagaaccttcgctcacaggcccaagattttaggcagcagggaacaaagatgagaagaaagatgtggcttcagaatatgaagataaaattgatcgttctgggtatcctgattgccttgattcttatcattgtgctgtctgtctgccatggcttcaattgttaaaatctgtcttggatttcccttgttctgctttttgctgccttgctgactggagtctcgatagattggtttgttttactttgttgttttaggtcgcatatttctcccttcgcttgccatatagtaggatagagggagactttgtatcttggttgattgtataggttatagttccattgaaggatttcttctctcatgttgtaatggagaaatacttggatgcctgcatatccctccccccccccctttcttttgaaatgttattgacttggttgttttgacttgcaaaaaaaaaaaaaaaaaaaa

SEQ ID NO: 166 - protein, 219 aa, Gossypium hirsutum
  misc_feature: Ceres CLONE ID no.1850460
  misc_feature: Bit score of 180.4 for HMM based on sequences of FIGURE 13.
  misc_feature (127)..(215): Pfam Name: Synaptobrevin Pfam Description: Synaptobrevin
  misc_feature: Functional Homolog Of Ceres CLONE ID no. 41543 at SEQ ID NO. 160
MGQQSLIYSFVARGTVILAEYTEFTGNFTGIAAQCLQKLPASNNKFTYTCDGHTFNYLVEDGFTYCVVAVESAGRQVPIAFLERVKEDFNKRYGGGKAATATAKSLNREFGSKLKEHMQYCVDHPEEISKLAKVKAQVSEVKGVMMENIEKVLDRGEKIELLVDKTENLRSQAQDFRQQGTKMRRKMWLQNMKIKLIVLGILIALILIIVLSVCHGFNC

SEQ ID NO: 167 - DNA, 1042 bp, Gossypium hirsutum
  misc_feature: Ceres CLONE ID no.1808074
  misc_feature: Encodes the peptide sequence at SEQ ID NO 168
agtcacgctaccttgcttttcatctaagcgaaaagggaaaaggaaacaactctccttccttccgacgataaaaacccttccccttcctcttgctcttcatttcaattcattcttccttagtcaaaggactgtgatggggcaacaatcgctgatctacgccttcgtggcacgaggcaccgtcgttttagccgactacaccgagttctccggcaacttcacctccattgcttctcagtgcctccagaaacttcctgcttccaacaacaagttcacttacaactgcgacggccatacctttaactatctcgttgataacggctttacttactgtgtggttgctgttgaatctgctgggcgacaggtgccaattgcctttcttgagagaattaaggaggattttaccaagagatatggtggaggaaaagctgcagctgctcctgcaaacagcttgagcaaggagtttgggccaaagttgaaggagcatatgcagtattgcattgatcatccagaggaggttagtaagattgccaaagtgaaagctcaagtttcagaagtcaaaggagttatgatggaaaacattgagaaggttctggaccgtggtgaaaaaattgagcttttggtggataaatcagaaaatcttcgctcccaggcacaagatttcaggcagcaggggacccagatgaggagaaagatgtggttacagaacatgaaaataaagctgatcgtgctcgggattctgatcgccttgattctcatcatcgtactgtctgtctgtcatggcttcaactgttgatgaatcactcagttgctatattctattcatttgcccactcattgatcggtgttgtagctgtcaccagtaatattgatgctcctcatagttagtagttacagttttctttaattccacgtccttttctgctgtagcctaatatcagaagactctctgcatatatactgagattcgaactatggaaattgaattttgaaatatataaaaatatcaaataaggtactttcagaaaaaaaaaaaaaaaaaaaa

SEQ ID NO: 168 - protein, 219 aa, Gossypium hirsutum
  misc_feature: Ceres CLONE ID no.1808074
  misc_feature: Bit score of 169.0 for HMM based on sequences of FIGURE 13.
  misc_feature (127)..(215): Pfam Name: Synaptobrevin Pfam Description: Synaptobrevin
  misc_feature: Functional Homolog Of Ceres CLONE ID no. 41543 at SEQ ID NO. 160
MGQQSLIYAFVARGTVVLADYTEFSGNFTSIASQCLQKLPASNNKFTYNCDGHTFNYLVDNGFTYCVVAVESAGRQVPIAFLERIKEDFTKRYGGGKAAAAPANSLSKEFGPKLKEHMQYCIDHPEEVSKIAKVKAQVSEVKGVMMENIEKVLDRGEKIELLVDKSENLRSQAQDFRQQGTQMRRKMWLQNMKIKLIVLGILIALILIIVLSVCHGFNC

SEQ ID NO: 169 - DNA, 1094 bp, Gossypium hirsutum
  misc_feature: Ceres CLONE ID no.1832882
  misc_feature: Encodes the peptide sequence at SEQ ID NO 170
aatttttaaaccttattaaccctttttcactttccatttttacttcttgtttctagatatatcaaaaaagtccaacaaaagagtaattgtgaagagaaaccaagggggaaaaagcaatagaaaagagcaagcaagcttcaaatcccagatctctctttgttttctccttgaaacccaaattttcccaaataagaaaagcttctgagaaaatggtgcccaaatcattgatctatgcatttgtatctcgtggaggagttatattagctgagtatactgaatacagtgggaatttcaattccatagctcttcaatgcctccaaaagcttccttcttcaaacaacaagttcacttacaactgtgatggccataccttcaattatcttgttgacaatggatacacttattgcgttgttgcagatgagtcagctggaaggcaagtgccgattgcttttttggagcgtatcaaggatgatttcgtgtcgaaatatgataacgggaaggctgctacagctcctgccaacagcctgaacaaggaatttgggccaaaactgaaagaacatatgcaatactgtatggagcatcctgaagaaataagcaagctagctaaggtcaaagctcaggtttctgaagtcaaaggtgttatgatggagaacatcgaaaaggtgttagatagaggggaaaagatagagctgctagtggataagactgagaatcttcataatcaggctcaagactttcgaagtacagggacaaaaatccgaagaaaaatgtggctacaaaacatgaagatcaagctgattgttctaggaatacttattgccttgatccttatcattgtcctctctgtttgccatggtttcaactgtggcaaaaaataaatgctattcttagaaggctgtattagctttcaccgcagcttttgtgatataatcttgtaagggaaagtttaaaatacatacatatatatataatactttatatgtcataaaagacttaacatttagcaatcaccaggtgactggtgtaagttattttttattgtgaagaaaaaaaaaaaaaaaaaaaaaaaaaaataaaaaaaaaaaaaaaaaaaa

SEQ ID NO: 170 - protein, 222 aa, Gossypium hirsutum
  misc_feature: Ceres CLONE ID no.1832882
  misc_feature: Bit score of 170.1 for HMM based on sequences of FIGURE 13.
  misc_feature (127)..(215): Pfam Name: Synaptobrevin Pfam Description: Synaptobrevin
  misc_feature: Functional Homolog Of Ceres CLONE ID no. 41543 at SEQ ID NO. 160
MVPKSLIYAFVSRGGVILAEYTEYSGNFNSIALQCLQKLPSSNNKFTYNCDGHTFNYLVDNGYTYCVVADESAGRQVPIAFLERIKDDFVSKYDNGKAATAPANSLNKEFGPKLKEHMQYCMEHPEEISKLAKVKAQVSEVKGVMMENIEKVLDRGEKIELLVDKTENLHNQAQDFRSTGTKIRRKMWLQNMKIKLIVLGILIALILIIVLSVCHGFNCGKK

SEQ ID NO: 171 - DNA, 979 bp, Gossypium hirsutum
  misc_feature: Ceres CLONE ID no.1978977
  misc_feature: Encodes the peptide sequence at SEQ ID NO 172
attttctttttccttttccttttccaaaaacctccgatacttcctctctccctttcctccgattctatatctctctctttctgctagggtttgggagttagtgaagaaggggttgttatttcatggggcaacaatcgttgatctacgccttcgtggcacgaggcaccgtggtcttagccgactatacggagttcaccggaaacttcaccggcatagcttctcagtgtctccagaaacttccttcttcaaacaacaagttcacttacaactgcgatggccatacctttaactatctcgtcgataacggcttcacttattgtgtggttgctattgaatccgttggcagacaggttcctatggcatttcttgagagaattaaagaggatttcaccaagagatatggcggaggaaaagctgcatctgcccctgcaaacagcctgagcaaggagtttgggccaaaattaaaggagcatatgcagtattgcattgatcatcctgaggagatcagtaagattgccaaagtgaaagctcaagtttcagaagttaaaggagttatgatggaaaacattgagaaggttctggaccgtggtgagagaattgagcttctggtggatagaacagaaaatcttcgttctcaggcacaagattttcggcagcagggaacccagatgaggagaaagatgtggttacagaacatgaaggtaaagcttatagttctcggaatcttggtcgctttgatcctcatcattgtactgtctgtttgtcacggcttcaaatgttcatgaattgcatgtccgctctacattccatcggcaactcccagatcagaattattgcaatcacaagtaatgtctaatgcttcttctagttagatttcttttctttttttgtgaaattacatgtgggtcatgtataaccatatcagaagactgcatttagaatataagtttgtgtttctgaaaaaaaaaaaaaaaaaaaa

SEQ ID NO: 172 - protein, 220 aa, Gossypium hirsutum
  misc_feature: Ceres CLONE ID no.1978977
  misc_feature: Bit score of 173.6 for HMM based on sequences of FIGURE 13.
  misc_feature (127)..(215): Pfam Name: Synaptobrevin Pfam Description: Synaptobrevin
  misc_feature: Functional Homolog Of Ceres CLONE ID no. 41543 at SEQ ID NO. 160
MGQQSLIYAFVARGTVVLADYTEFTGNFTGIASQCLQKLPSSNNKFTYNCDGHTFNYLVDNGFTYCVVAIESVGRQVPMAFLERIKEDFTKRYGGGKAASAPANSLSKEFGPKLKEHMQYCIDHPEEISKIAKVKAQVSEVKGVMMENIEKVLDRGERIELLVDRTENLRSQAQDFRQQGTQMRRKMWLQNMKVKLIVLGILVALILIIVLSVCHGFKCS

SEQ ID NO: 173 - DNA, 1308 bp, Gossypium hirsutum
  misc_feature: Ceres CLONE ID no.1918742
  misc_feature: Encodes the peptide sequence at SEQ ID NO 174
agagtctacaacttcttcagctttgaaatattacctccacctccactcctctcctctcccattttatttctaaatatgtaactttttaattttaattttaattttaattgcagaaaagaattagtactcacaaaattaactacatttaccgcaatttcagcatttcgtcgttaatcctattttcttgtccgatcccatcccatccagactcttcactctctttcctttaatctgttttcattttctgtcatttgcaaattgaatttttggttcttgagttctaggtttagggttttgagagatggggcaacagacgttgatctacagctttgtggctcgtggcatggtgatcctcgctgagtataccgagttcaccggtaacttcacaagcattgccggtcaatgtctccagaagctcccttcttccaacaacaaatttacctacaattgcgatggccacaccttcaattatctcgttgagaatggattcacctactgtgtggttgcagttgaatctgctggcaggcaaattccaattgcatttctggaaagaattaaagaagacttcagcagaagatacggtggagggaaggctgcaactgctactgccaagagcctgaatagagaatttaagtccaaattgaaggagcatatgaagtattgtgtggaacatcctgaagagatcagcaaacttgccaaagtgaaggcccaagtttctgaagtcaagggtgttatgatggaaaatattgagaaggtacttgaccgtggtgagaagattgagttgctggtggataaaactgaaaaccttcgttcacaggcacaagattttaggcagcagggaactaagataaaaagaaagatgtggattgagaacatgaagatgaaattgattgtgttcgggatcgttcttgccttggttcttataattgtgctgtcagtctgccctggcttcaaatgttaaaaactgtgaggatagccatccctggtacagctgttgttgcgatgatgccaactgggttgtcttgatagacgatgggtctatataaattcatttatttgtttagttcacatatatttctccctttgctagccgtttaggacagggagaggcttctgcatctcggttgtctgtgtgtataggatttagttgggaacttatcacggtagataaatgtttctatcatttattttcttctttatgtgttgtgtaaggagaaatactcagatgcctgcttatcctatttgccccttccaaatattataaaaaatcattcttctttctgttatcaaaaaaaaaaaaaaaaaaaa

SEQ ID NO: 174 - protein, 219 aa, Gossypium hirsutum
  misc_feature: Ceres CLONE ID no.1918742
  misc_feature: Bit score of 158.5 for HMM based on sequences of FIGURE 13.
  misc_feature (127)..(215): Pfam Name: Synaptobrevin Pfam Description: Synaptobrevin
  misc_feature: Functional Homolog Of Ceres CLONE ID no. 41543 at SEQ ID NO. 160
MGQQTLIYSFVARGMVILAEYTEFTGNFTSIAGQCLQKLPSSNNKFTYNCDGHTFNYLVENGFTYCVVAVESAGRQIPIAFLERIKEDFSRRYGGGKAATATAKSLNREFKSKLKEHMKYCVEHPEEISKLAKVKAQVSEVKGVMMENIEKVLDRGEKIELLVDKTENLRSQAQDFRQQGTKIKRKMWIENMKMKLIVFGIVLALVLIIVLSVCPGFKC

SEQ ID NO: 175 - DNA, 1262 bp, Gossypium hirsutum
  misc_feature: Ceres CLONE ID no.1940023
  misc_feature: Encodes the peptide sequence at SEQ ID NO 176
aaaaataaaacaggtcttgattttaagataatcaacgaattagagcgaaaagtttaagaaatttaaactaattgtctttcccaaaatgctttgtaatgtattttgtggctaacccctaaagttttgcttaagcatcattcaattaaactcctttttcactttttcttatttcttttaagaaaagccaacaaatgagttattcttgagagaagaaagtggaaagcagtagtacgagaaagagagagcctctgaaatcccagatctctctttggaacccaaatttctaaggaaaatggtgcacaaatcattgatctatgcatttgtatctcgtggggaagttatcttagcagagtatactgaattcagtgggaatttcaattccatagcttttcaatgcctccaaaagcttccttcttctttctacgacaagttcacttacaactgtgatggccacaccttcaattaccttgttgacaatggctacacatattgtgttgttgcagatgaattggctggaaggcaagtaccgattgcttttttggagcgtgtcaaggaggactttgtgtcaaaatatggtagtggaaaggctgctactgctcctgccaacagcctgaacaaggaatttgggccaaaactaaaagaacatatgcagtattgtgttgagcatcctgaagaaataagcaagcttgctaagatcaaatctcaggtttctgaagtcaaaggtgttatgatggagaacatagagaaggtgttggatagaggggaaaagatagagcttctagtggataaaactgagaatcttcatcagcaggctcaagacttctggaatactgggacgaaaatccgaagaaaaatgtggctacaaaacatgaagatcaagctgattgttctaggaatattgattgcattgatcctcatcattgtcctctctgtttgccatggtttcaactatggtggaaaatgagtgccatctttattaggcttattattagagttttcaccagagctattatgataatattgtgatgaaaagatcaaaaaatatataatatgatgtcatatgctatatataagattagcaatcaccagatgtttggtgcaagatatttttggatgtgagcaaaccctgtaagtgcttattgcaatacatgaaattgttttctgcaacaatcagattattcatcttcatgcttcagagtcggtaggtaaaattttattcaagacaggaacttgttggatgctaaaaaaaaaaaaaaaaaaaa

SEQ ID NO: 176 - protein, 223 aa, Gossypium hirsutum
  misc_feature: Ceres CLONE ID no.1940023
  misc_feature: Bit score of 154.4 for HMM based on sequences of FIGURE 13.
  misc_feature (128)..(216): Pfam Name: Synaptobrevin Pfam Description: Synaptobrevin
  misc_feature: Functional Homolog Of Ceres CLONE ID no. 41543 at SEQ ID NO. 160
MVHKSLIYAFVSRGEVILAEYTEFSGNFNSIAFQCLQKLPSSFYDKFTYNCDGHTFNYLVDNGYTYCVVADELAGRQVPIAFLERVKEDFVSKYGSGKAATAPANSLNKEFGPKLKEHMQYCVEHPEEISKLAKIKSQVSEVKGVMMENIEKVLDRGEKIELLVDKTENLHQQAQDFWNTGTKIRRKMWLQNMKIKLIVLGILIALILIIVLSVCHGFNYGGK

SEQ ID NO: 177 - DNA, 1125 bp, Gossypium hirsutum
  misc_feature: Ceres CLONE ID no.1923495
  misc_feature: Encodes the peptide sequence at SEQ ID NO 178
attgaaactggaggctggatggagcaaactttttgggcaagttgcttaatagtttttcctaatccaaaggtggtttaagagagcttcagtaatggcccaaggtttagggttttgagagatggggcaacagacgttgatctacagctttgtggctcgtggcatggtgatcctcgctgagtataccgagttcaccggtaacttcacaagcattgccggtcaatgtctccagaagctcccttcttccaacaacaaatttacctacaattgcgatggccacaccttcaattatctcgttgagaatggatccacctactgtgtggttgcagttgaatctgctggcaggcaaattccaattgcatttctggaaagaattaaagaagacttcagcagaagatacggtggagggaaggctgcaactgctactgccaagagcctgaatagagaatttaagtccaaattgaaggagcatatgaagtattgtgtggaacatcctgaagagatcagcaaacttgccaaagtgaaggcccaagtttctgaagtcaagggtgttatgatggaaaatattgagaaggtacttgaccgtggtgagaagattgagttgctggtggataaaactgaaaaccttcgttcacaggcacaagattttaggcagcagggaactaagataaaaagaaagatgtggattgagaacatgaagatgaaattgattgtgttcgggatcgttcttgccttggttcttataattgtgctgtcagtctgccctggcttcaaatgttaaaaactgtgaggatagccatccctggtacagctgttgttgcgatgatgccaactgggttgtcttgatagacgatgggtctatataaattcatttatttgtttagttcacatatatttctccctttgctagccgtttaggacagggagaggcttctgcatctcggttgtctgtgtgtataggatttagttgggaacttatcacggtagataaatgtttctatcatttattttcttctttatgtgttgtgtaaggagaaatactcagatgcctgcttatcctatttgccccttccaaatattataaaaaatcattcttctttctgttatcaaaaaaaaaaaaaaaaaaaa

SEQ ID NO: 178 - protein, 219 aa, Gossypium hirsutum
  misc_feature: Ceres CLONE ID no.1923495
  misc_feature: Bit score of 156.1 for HMM based on sequences of FIGURE 13.
  misc_feature (127)..(215): Pfam Name: Synaptobrevin Pfam Description: Synaptobrevin
  misc_feature: Functional Homolog Of Ceres CLONE ID no. 41543 at SEQ ID NO. 160
MGQQTLIYSFVARGMVILAEYTEFTGNFTSIAGQCLQKLPSSNNKFTYNCDGHTFNYLVENGSTYCVVAVESAGRQIPIAFLERIKEDFSRRYGGGKAATATAKSLNREFKSKLKEHMKYCVEHPEEISKLAKVKAQVSEVKGVMMENIEKVLDRGEKIELLVDKTENLRSQAQDFRQQGTKIKRKMWIENMKMKLIVFGIVLALVLIIVLSVCPGFKC

SEQ ID NO: 179 - protein, 377 aa, Arabidopsis thaliana
  misc_feature: Public GI ID no.15235713
  misc_feature: Bit score of 804.4 for HMM based on sequences of FIGURE 9.
  misc_feature (111)..(355): Pfam Name: Trehalose_PPase Pfam Description: Trehalose-phosphatase
  misc_feature: Functional Homolog Of Ceres SEEDLINE ID no. ME20095 at SEQ ID NO. 1129
MDLNINKTTPVLSDPTTPVSKTRLGSSFPSGRFMMNSRKKIPKLDDVRSNGWLDAMISSSPPRKRLVKDFNIEIAPEDDFSQRAWMLKYPSAITSFAHIAAQAKNKKIAVFLDYDGTLSPIVDDPDRAIMSDAMRAAVKDVAKYFPTAIISGRSRDKVYQLVGLTELYYAGSHGMDIMTPVNPNGSPEDPNCIKTTDQQGEEVNLFQPAKEFIPVIEEVYNNLVEITKCIKGAKVENHKFCTSVHYRNVDEKDWPLVAQRVHDHLKRYPRLRITHGRKVLEVRPVIEWNKGKAVEFLLESLGLSNNDEFLPIFIGDDKTDEDAFKVLREGNRGFGILVSSVPKESNAFYSLRDPSEVKKFLKTLVKWGKMESSKTSF

SEQ ID NO: 180 - protein, 368 aa, Arabidopsis thaliana
  misc_feature: Public GI ID no.15234552
  misc_feature: Bit score of 788.0 for HMM based on sequences of FIGURE 9.
  misc_feature (108)..(346): Pfam Name: Trehalose_PPase Pfam Description: Trehalose-phosphatase
  misc_feature: Functional Homolog Of Ceres SEEDLINE ID no. ME20095 at SEQ ID NO. 1129
MDLNSNHKSSVLKDPSPSVNQSRLGVSSRFMMSQWKKPAKLDDVRSNGWLDAMISSSPPRKKLVKDFNVEVAPEDDFAQRAWMVKYPSAISSFAHIAAQAKKKKIAVFLDYDGTLSPIVDDPDRAIMSDAMRSAVKDVASYFPTAIISGRSRDKVYQLVGLTELYYAGSHGMDIMTSSDGPNCFKSTDQQGKEVNLFQPAREFIPVIDEVFRTLVEKMKDIKGAKVENHKFCASVHYRNVDEKDWPIIAQRVHDHLKQYPRLRLTHGRKVLEVRPVIDWNKGRAVEFLLESLGLSNKDDLLPIYIGDDTTDEDAFKVLRDGNRGFGILVSSIPKESNAFYSLRDPSEVKKFLKTLVKWAKLEKNSTGF

SEQ ID NO: 181 - DNA, 1029 bp, Gossypium hirsutum
  misc_feature: Ceres CLONE ID no.1851388
  misc_feature: Encodes the peptide sequence at SEQ ID NO 182
gtttcaggtaagcttttcttcatctgaacttcctttctttgatgatctaggtacttcagaataccctgctgaaatgaatcaaaagggcttgatttatagttttgttgcaaaaggaactgttgttttagctgagcacacatcatattctgggaactttagtaccattgctgttcaatgtttacagaagctgccttcaaatagcagcaagttcacgtattcttgtgacggtcacacatttaacttcctcattgacaatggatttgtgtttctagttgtcgcagatgaatcagttggcaggagtgtgcctttcgtttttcttgaacgggtgctagatgattttaaacaacgatatggtgcaagtataagaaatgagggtccccatcctttagctgatgatgacgatgatgacgacttatttgaggaccaatttagcattgcatataatcttgacagagaatttggaccaaggcttaaggagcacatgcaatattgtatgaaccatccagaagaaatgagtaagctctcgaagttaaaagctcaaatcactgaggtgaaggggattatgatggataacattgagaaggttttggatcgcggggagaagattgaacttctagtggacaaaactgagaacttacaattccaggctgatagcttccagaggcaagggcggcaactgcggcggaggatgtggctgcagaatctgcaaatgaaactgatggtggggggagctattcttgtgttgatcatccttttgtgggtttttgcgtgtggaggtttcaaatgttaacgttgataaccattgcattgcctatgttttcttttatatatacaaaaaataataattctacatttgtttagatgtacaaaatatagttatgctcttgactttgtacatggattgctgttgttatgtagcactaccttgccgtttaagatatgtaatcaaagctttgaattttatacttttttgaagttttctatatgaatgttttttacttgtaaaaaaaaaaaaaaaaaaaaaaaaaa

SEQ ID NO: 182 - protein, 238 aa, Gossypium hirsutum
  misc_feature: Ceres CLONE ID no.1851388
  misc_feature: Bit score of 164.3 for HMM based on sequences of FIGURE 13.
  misc_feature (146)..(234): Pfam Name: Synaptobrevin Pfam Description: Synaptobrevin
  misc_feature: Functional Homolog Of Ceres CLONE ID no. 41543 at SEQ ID NO. 160
MNQKGLIYSFVAKGTVVLAEHTSYSGNFSTIAVQCLQKLPSNSSKFTYSCDGHTFNFLIDNGFVFLVVADESVGRSVPFVFLERVLDDFKQRYGASIRNEGPHPLADDDDDDDLFEDQFSIAYNLDREFGPRLKEHMQYCMNHPEEMSKLSKLKAQITEVKGIMMDNIEKVLDRGEKIELLVDKTENLQFQADSFQRQGRQLRRRMWLQNLQMKLMVGGAILVLIILLWVFACGGFKC

SEQ ID NO: 183 - DNA, 663 bp, Populus balsamifera subsp. trichocarpa
  misc_feature: Ceres ANNOT ID no.1531178
  misc_feature: Encodes the peptide sequence at SEQ ID NO 184
atggcgatcctgtacgcgctagtggcgaggggatctgtggtgctagcggagtttacctcgacggcgacaaacgcaagcgcgattgctcggcaaatattggacaagataccaggcaatgatgatagcaacgtctcttactctcaagatcgttatatttttcacgttaaacgcaccgatggccttaccgttctctgtatggccgatgaaaccgccggcagaagaattccctttgcgtttctcgaggacattcatcagagatttgtgaggacgtatggtcgtgcagttattacagctcaagcttatgccatgaatgatgagttctcaagagttttgagccagcaaatggagtactatactaacgatcctaatgcagataggataaatagactgaaaggtgaaatgagtcaggtgagaaatgtcatgattgagaacattgacaaagttttggagagaggtgatcgcttggaattgctggttgataaaacagctaacatgcaaggaaacaccttccgtttcagaaagcaagctcgtcgtttcagaagcactgtatggtggagaaatgttaagcttacggttgctttgattttattactactagtgatcatctatgttgtgctggcttttgtatgccatggacttacactacctacgtgcctaaagtaa

SEQ ID NO: 184 - protein, 220 aa, Populus balsamifera subsp. trichocarpa
  misc_feature: Ceres ANNOT ID no.1531178
  misc_feature: Bit score of 663.4 for HMM based on sequences of FIGURE 13.
  misc_feature (123)..(211): Pfam Name: Synaptobrevin Pfam Description: Synaptobrevin
  misc_feature: Functional Homolog Of Ceres CLONE ID no. 41543 at SEQ ID NO. 160
MAILYALVARGSVVLAEFTSTATNASAIARQILDKIPGNDDSNVSYSQDRYIFHVKRTDGLTVLCMADETAGRRIPFAFLEDIHQRFVRTYGRAVITAQAYAMNDEFSRVLSQQMEYYTNDPNADRINRLKGEMSQVRNVMIENIDKVLERGDRLELLVDKTANMQGNTFRFRKQARRFRSTVWWRNVKLTVALILLLLVIIYVVLAFVCHGLTLPTCLK

SEQ ID NO: 185 - DNA, 783 bp, Populus balsamifera subsp. trichocarpa
  misc_feature: Ceres ANNOT ID no.1477681
  misc_feature: Encodes the peptide sequence at SEQ ID NO 186
atggcgatcctgtacgcgctagtggcgaggggatctgtggtgctagcggagtttacctcgacggcgacaaacgcaagcgcgattgctcggcaaatattggacaagataccaggcaatgatgatagcaacgtctcttactctcaagatcgttatatttttcacgttaaacgcaccgatggccttaccgttctctgtatggccgatgaaaccgccggcagaagaattccctttgcgtttctcgaggacattcatcagagatttgtgaggacgtatggtcgtgcagttattacagctcaagcttatgccatgaatgatgagttctcaagagttttgagccagcaaatggagtactatactaacgatcctaatgcagataggataaatagactgaaaggtgaaatgagtcaggtgagaaatgtcatgattgagaacattgacaaagttttggagagaggtgatcgcttggaattgctggttgataaaacagctaacatgcaaggaaacaccttccgtttcagaaagcaagctcgtcgtttcagaagcactgtatggtggagaaatgttaagcttacggttgctttgattttattactactagtgatcatctatgttgtgctggcttttgtatgccatggacttacactacctacgtgcctaaaccatcatgggattcacccctcagcctcctttgacttaatccctagttactacgaagaaaaggtctttcggagggacttgggacgaatgaggaatgggtctttgttagttactggtcatggctga

SEQ ID NO: 186 - protein, 260 aa, Populus balsamifera subsp. trichocarpa
  misc_feature: Ceres ANNOT ID no.1477681
  misc_feature: Bit score of 661.9 for HMM based on sequences of FIGURE 13.
  misc_feature (123)..(211): Pfam Name: Synaptobrevin Pfam Description: Synaptobrevin
  misc_feature: Functional Homolog Of Ceres CLONE ID no. 41543 at SEQ ID NO. 160
MAILYALVARGSVVLAEFTSTATNASAIARQILDKIPGNDDSNVSYSQDRYIFHVKRTDGLTVLCMADETAGRRIPFAFLEDIHQRFVRTYGRAVITAQAYAMNDEFSRVLSQQMEYYTNDPNADRINRLKGEMSQVRNVMIENIDKVLERGDRLELLVDKTANMQGNTFRFRKQARRFRSTVWWRNVKLTVALILLLLVIIYVVLAFVCHGLTLPTCLNHHGIHPSASFDLIPSYYEEKVFRRDLGRMRNGSLLVTGHG

SEQ ID NO: 187 - DNA, 663 bp, Populus balsamifera subsp. trichocarpa
  misc_feature: Ceres ANNOT ID no.1508800
  misc_feature: Encodes the peptide sequence at SEQ ID NO 188
atggcgatcctgtacgcgctagtggcaaggggatcggtggtgctagcggagtttagctctacagcaacgaacgcaagcgcgattgctaggcaaatactggataagatacctggcaatgatgatagcaatgtctcttactctcaagatcgttatatttttcatgttaaacgcaccgatggcctcgccgttctttgcatggccgatgaaaccgccggcagaagaattccgtttgcatttcttgaggacattcatcagagatttgccaggacttatggacgtgcagttattacagctcaagcttatgccatgaatgatgaattctcaagagttttgagccaacaaatggagtactacactaatgatccgaatgcagataggataaatagactgaaaggtgaaatgagccaggtgcgaaatgttatgattgagaacattgacaaagttttggagagaggtgatcgcttggaattgctggtagataaaaccgccaacatgcaaggaaacaccttccgtttcagaaagcaagctcgtcgtttcagcagcgcagtatggtggagaaatgtcaagctcacggttgctttgattttactactactagtgattatctacgttgtgctggccgttgtatgccatggagttacactgcctacatgccgaaagtaa

SEQ ID NO: 188 - protein, 220 aa, Populus balsamifera subsp. trichocarpa
  misc_feature: Ceres ANNOT ID no.1508800
  misc_feature: Bit score of 643.2 for HMM based on sequences of FIGURE 13.
  misc_feature (123)..(211): Pfam Name: Synaptobrevin Pfam Description: Synaptobrevin
  misc_feature: Functional Homolog Of Ceres CLONE ID no. 41543 at SEQ ID NO. 160
MAILYALVARGSVVLAEFSSTATNASAIARQILDKIPGNDDSNVSYSQDRYIFHVKRTDGLAVLCMADETAGRRIPFAFLEDIHQRFARTYGRAVITAQAYAMNDEFSRVLSQQMEYYTNDPNADRINRLKGEMSQVRNVMIENIDKVLERGDRLELLVDKTANMQGNTFRFRKQARRFSSAVWWRNVKLTVALILLLLVIIYVVLAVVCHGVTLPTCRK

SEQ ID NO: 189 - DNA, 738 bp, Populus balsamifera subsp. trichocarpa
  misc_feature: Ceres ANNOT ID no.1455597
  misc_feature: Encodes the peptide sequence at SEQ ID NO 190
atggcgatcctgtacgcgctagtggcaaggggatcggtggtgctagcggagtttagctctacagcaacgaacgcaagcgcgattgctaggcaaatactggataagatacctggcaatgatgatagcaatgtctcttactctcaagatcgttatatttttcatgttaaacgcaccgatggcctcgccgttctttgcatggccgatgaaaccgccggcagaagaattccgtttgcatttcttgaggacattcatcagagatttgccaggacttatggacgtgcagttattacagctcaagcttatgccatgaatgatgaattctcaagagttttgagccaacaaatggagtactacactaatgatccgaatgcagataggataaatagactgaaaggtgaaatgagccaggtgcgaaatgttatgattgagaacattgacaaagttttggagagaggtgatcgcttggaattgctggtagataaaaccgccaacatgcaaggaaacaccttccgtttcagaaagcaagctcgtcgtttcagcagcgcaggttgctttgattttactactactagtgattatctacgttgtgctggccgttgtatgccatggagttacactgcctacatgccgaaatattatcgacgggaagggagaggggaggcgcctgtcaagtttccagaatcttgtttatttttcttctctgattccattcagaaagatgcatcttctgtggaatga

SEQ ID NO: 190 - protein, 245 aa, Populus balsamifera subsp. trichocarpa
  misc_feature: Ceres ANNOT ID no.1455597
  misc_feature: Bit score of 499.2 for HMM based on sequences of FIGURE 13.
  misc_feature (123)..(179): Pfam Name: Synaptobrevin Pfam Description: Synaptobrevin
  misc_feature: Functional Homolog Of Ceres CLONE ID no. 41543 at SEQ ID NO. 160
MAILYALVARGSVVLAEFSSTATNASAIARQILDKIPGNDDSNVSYSQDRYIFHVKRTDGLAVLCMADETAGRRIPFAFLEDIHQRFARTYGRAVITAQAYAMNDEFSRVLSQQMEYYTNDPNADRINRLKGEMSQVRNVMIENIDKVLERGDRLELLVDKTANMQGNTFRFRKQARRFSSAGCFDFTTTSDYLRCAGRCMPWSYTAYMPKYYRREGRGEAPVKFPESCLFFFSDSIQKDASSVE

SEQ ID NO: 191 - DNA, 873 bp, Populus balsamifera subsp. trichocarpa
  misc_feature: Ceres ANNOT ID no.1532016
  misc_feature: Encodes the peptide sequence at SEQ ID NO 192
atggggatattgtatggcatggtggcaagaggtcctgtggtcttggcagaatttagcagcattgcacaaacaaatgcaaacaccgtagcaaggcagattcttgataaaatccctcgtggaaatgaagatagtaattcatcgtattctcatgatcgttacatttttcatgttaaaagaaccgatgaccttaccgttctttgcatggctgatgatgccaccggacggagaatcccatttgaatttctcgaggacattcatcaaagatttgtgaagacatacggccgtgcaattcatacatctgctccctatgccatgaatgaagagttttccaggatcatgagccaacagatggaccatttttcaaatgatccgaatgcggatcgattgaaccgtttacagggtgaaatgagtcatgtaaggagtgtcatgatcgacaacattgacaaagtgttgcagaggggagatcggctggcgctgctagttgaaaaaacttccacattgcaaggaaatacaattcgctttcggcgacagactcagcgtttcagaaatacacagtggtggagaaatttcaagctcaaactttgtacttgcttcggatgtgcatttgttgaccatgttgtgcttaagaaggaatggaatttgcacaaggacaacctgggtttcacactggactcaagttatctgcagattactagttctcatggtagacaaatggaggacatgttttctctgtcccgagattacaaaactctacctaagagatgtcgtgttttatcatccatggctacattgatactatttctcttgattttcatttatactgtactcgcattgttttgtcacggcccttcacttcattcctgcttgaagtag

SEQ ID NO: 192 - protein, 290 aa, Populus balsamifera subsp. trichocarpa
  misc_feature: Ceres ANNOT ID no.1532016
  misc_feature: Bit score of 461.4 for HMM based on sequences of FIGURE 13.
  misc_feature (125)..(195): Pfam Name: Synaptobrevin Pfam Description: Synaptobrevin
  misc_feature: Functional Homolog Of Ceres CLONE ID no. 41543 at SEQ ID NO. 160
MGILYGMVARGPVVLAEFSSIAQTNANTVARQILDKIPRGNEDSNSSYSHDRYIFHVKRTDDLTVLCMADDATGRRIPFEFLEDIHQRFVKTYGRAIHTSAPYAMNEEFSRIMSQQMDHFSNDPNADRLNRLQGEMSHVRSVMIDNIDKVLQRGDRLALLVEKTSTLQGNTIRFRRQTQRFRNTQWWRNFKLKLCTCFGCAFVDHVVLKKEWNLHKDNLGFTLDSSYLQITSSHGRQMEDMFSLSRDYKTLPKRCRVLSSMATLILFLLIFIYTVLALFCHGPSLHSCLK

SEQ ID NO: 193 - DNA, 915 bp, Populus balsamifera subsp. trichocarpa
  misc_feature: Ceres ANNOT ID no.1478526
  misc_feature: Encodes the peptide sequence at SEQ ID NO 194
atggggatattgtatggcatggtggcaagaggtcctgtggtcttggcagaatttagcagcattgcacaaacaaatgcaaacaccgtagcaaggcagattcttgataaaatccctcgtggaaatgaagatagtaattcatcgtattctcatgatcgttacatttttcatgttaaaagaaccgatgaccttaccgttctttgcatggctgatgatgccaccggacggagaatcccatttgaatttctcgaggacattcatcaaagatttgtgaagacatacggccgtgcaattcatacatctgctccctatgccatgaatgaagagttttccaggatcatgagccaacagatggaccatttttcaaatgatccgaatgcggatcgattgaaccgtttacagggtgaaatgagtcatgtaaggagtgtcatgatcgacaacattgacaaagtgttgcagaggggagatcggctggcgctgctagttgaaaaaacttccacattgcaaggaaatacaattcgctttcggcgacagactcagcgtttcagaaatacacagtggtggagaaatttcaagctcaaactttgtacttgcttcggatgtgcatttgttgaccatgttgtgcttaagaaggaatggaatttgcacaaggacaacctgggtttcacactggactcaagttatctgcagattactagttctcatggtagacaaatggaggacatgttttctctgtcccgagattacaaaactctacctaagagatgtcgtgttttatcatccattcaaagcccgtttttacttgcaacgggcggccttggagaggatctggaaactagtattggacgcaagcgcaaggcctttatatgtgtgtctagcgcccagctccttgcacctaccctgcaccccgcgtcctag

SEQ ID NO: 194 - protein, 304 aa, Populus balsamifera subsp. trichocarpa
  misc_feature: Ceres ANNOT ID no.1478526
  misc_feature: Bit score of 461.4 for HMM based on sequences of FIGURE 13.
  misc_feature (125)..(195): Pfam Name: Synaptobrevin Pfam Description: Synaptobrevin
  misc_feature: Functional Homolog Of Ceres CLONE ID no. 41543 at SEQ ID NO. 160
MGILYGMVARGPVVLAEFSSIAQTNANTVARQILDKIPRGNEDSNSSYSHDRYIFHVKRTDDLTVLCMADDATGRRIPFEFLEDIHQRFVKTYGRAIHTSAPYAMNEEFSRIMSQQMDHFSNDPNADRLNRLQGEMSHVRSVMIDNIDKVLQRGDRLALLVEKTSTLQGNTIRFRRQTQRFRNTQWWRNFKLKLCTCFGCAFVDHVVLKKEWNLHKDNLGFTLDSSYLQITSSHGRQMEDMFSLSRDYKTLPKRCRVLSSIQSPFLLATGGLGEDLETSIGRKRKAFICVSSAQLLAPTLHPAS

SEQ ID NO: 195 - DNA, 729 bp, Populus balsamifera subsp. trichocarpa
  misc_feature: Ceres ANNOT ID no.1492567
  misc_feature: Encodes the peptide sequence at SEQ ID NO 196
atggcgatcatttatgcggtagtggcgaggggaacggtggtgctgtctgagttcagcgcggtgacgggaaacacaggagcggtggcgagacggatcctggagaagcttccatcggaagctgattcaaggctttgcttctcgcaagatcgttacatatttcacatactcagatccgatggcctcacttttctctgtatggcaaacgacaccttcggcaggaggattccgtttacgtacttggaggacattcacatgaggttcatgaaaaactatggacgagttgctcactatgcgccagcctatgcaatgaatgatgagttctcaagggtcctgcatcagcaaatggaattcttctccagcaatcctagtgctgatactctcagtcgtgtaagaggtgaagttggcgaggcaagagaaaacatcaagcacaacaatcctccaagacagtggcttgaacccaaaagaggggggaatatccgtacaattatggtagaaaacatcgagaaaatacttgagagaggtgaccgaattgagcttcttgttgacaaaacagcaacgatgcaagatggtgcatttcacttcaagaaacagtccaagggccttcgaagagctctctggatgaagaatgctaagctcttggccctgctgacatgcgtgattgttttgttgctgtacataataattgctgcttgttgtggaggcatcactctaccttcatgcagatcttga

SEQ ID NO: 196 - protein, 242 aa, Populus balsamifera subsp. trichocarpa
  misc_feature: Ceres ANNOT ID no.1492567
  misc_feature: Bit score of 526.6 for HMM based on sequences of FIGURE 13.
  misc_feature (159)..(233): Pfam Name: Synaptobrevin Pfam Description: Synaptobrevin
  misc_feature: Functional Homolog Of Ceres CLONE ID no. 41543 at SEQ ID NO. 160
MAIIYAVVARGTVVLSEFSAVTGNTGAVARRILEKLPSEADSRLCFSQDRYIFHILRSDGLTFLCMANDTFGRRIPFTYLEDIHMRFMKNYGRVAHYAPAYAMNDEFSRVLHQQMEFFSSNPSADTLSRVRGEVGEARENIKHNNPPRQWLEPKRGGNIRTIMVENIEKILERGDRIELLVDKTATMQDGAFHFKKQSKGLRRALWMKNAKLLALLTCVIVLLLYIIIAACCGGITLPSCRS

SEQ ID NO: 197 - DNA, 726 bp, Populus balsamifera subsp. trichocarpa
  misc_feature: Ceres ANNOT ID no.1515273
  misc_feature: Encodes the peptide sequence at SEQ ID NO 198
atggcgattatttatgcggttgtggcgcgggggacggtggtgctgtcagagttcagcgctgtgaccggaaactcaggggcggtggcgagacggatcctggagaagcttccatcggaagctgattcaagactttgcttctcgcaagatcgttacatattccacatacttagatccgacggcctcacttatctctgtatggccaacgacaccttcggcaggagaattccattttcctacttggaggacattcagatgaggttcatgaaaaattatggacgagttgcccaccatgcacctgcttatgcagtgaatgatgagttttctagggttttgcatcagcaaatggagtttttctccagcaaccctagtgctgatactctgagtcgtatccgtactatcatggtagaaaacattgaaaaaatactcgaaagaggtgaccgaattgagcttctcgttgacaaaactgctacaatgcaagatggtgcttttcatttcaagaaacagtccaagcgcctacgaagagctctttggatgaaaaatgccaagctcttgagtaatctggaatttgctagggaaaagggcagttttaggctagaaaatgtgagaagtagaaaaaggaaggacctctcaatgggggccctgctgacatgcgtgattgtcttgttgctgtacataataattgctgcttgttgtggcggcatcactctaccttcatgcagatcttga

SEQ ID NO: 198 - protein, 241 aa, Populus balsamifera subsp. trichocarpa
  misc_feature: Ceres ANNOT ID no.1515273
  misc_feature: Bit score of 484.3 for HMM based on sequences of FIGURE 13.
  misc_feature (130)..(183): Pfam Name: Synaptobrevin Pfam Description: Synaptobrevin
  misc_feature: Functional Homolog Of Ceres CLONE ID no. 41543 at SEQ ID NO. 160
MAIIYAVVARGTVVLSEFSAVTGNSGAVARRILEKLPSEADSRLCFSQDRYIFHILRSDGLTYLCMANDTFGRRIPFSYLEDIQMRFMKNYGRVAHHAPAYAVNDEFSRVLHQQMEFFSSNPSADTLSRIRTIMVENIEKILERGDRIELLVDKTATMQDGAFHFKKQSKRLRRALWMKNAKLLSNLEFAREKGSFRLENVRSRKRKDLSMGALLTCVIVLLLYIIIAACCGGITLPSCRS

SEQ ID NO: 199 - DNA, 810 bp, Populus balsamifera subsp. trichocarpa
  misc_feature: Ceres ANNOT ID no.1461979
  misc_feature: Encodes the peptide sequence at SEQ ID NO 200
atggcgattatttatgcggttgtggcgcgggggacggtggtgctgtcagagttcagcgctgtgaccggaaactcaggggcggtggcgagacggatcctggagaagcttccatcggaagctgattcaagactttgcttctcgcaagatcgttacatattccacatacttagatccgacggcctcacttatctctgtatggccaacgacaccttcggcaggagaattccattttcctacttggaggacattcagatgaggttcatgaaaaattatggacgagttgcccaccatgcacctgcttatgcagtgaatgatgagttttctagggttttgcatcagcaaatggagtttttctccagcaaccctagtgctgatactctgagtcgtatccgtactatcatggtagaaaacattgaaaaaatactcgaaagaggtgaccgaattgagcttctcgttgacaaaactgctacaatgcaagatggtgcttttcatttcaagaaacagtccaagcgcctacgaagagctctttggatgaaaaatgccaagctcttgagtaatctggaatttgctagggaaaagggcagttttaggctagaaaatgtgagaagtagaaaaaggaaggacctctcaatggggagtaccctggagttttctagggaaaagggcagttttaggctagaaaaaggccctgctgacatgcgtgattgtcttgttgctgtacataataattgctgcttgttgtggcggcatcactctaccttcatgcagatcttgagatgctgtttcgctggtgctgaatttaccctctga

SEQ ID NO: 200 - protein, 269 aa, Populus balsamifera subsp. trichocarpa
  misc_feature: Ceres ANNOT ID no.1461979
  misc_feature: Bit score of 437.1 for HMM based on sequences of FIGURE 13.
  misc_feature (130)..(183): Pfam Name: Synaptobrevin Pfam Description: Synaptobrevin
  misc_feature: Functional Homolog Of Ceres CLONE ID no. 41543 at SEQ ID NO. 160
MAIIYAVVARGTVVLSEFSAVTGNSGAVARRILEKLPSEADSRLCFSQDRYIFHILRSDGLTYLCMANDTFGRRIPFSYLEDIQMRFMKNYGRVAHHAPAYAVNDEFSRVLHQQMEFFSSNPSADTLSRIRTIMVENIEKILERGDRIELLVDKTATMQDGAFHFKKQSKRLRRALWMKNAKLLSNLEFAREKGSFRLENVRSRKRKDLSMGSTLEFSREKGSFRLEKGPADMRDCLVAVHNNCCLLWRHHSTFMQILRCCFAGAEFTL

SEQ ID NO: 201 - DNA, 804 bp, Populus balsamifera subsp. trichocarpa
  misc_feature: Ceres ANNOT ID no.1439702
  misc_feature: Encodes the peptide sequence at SEQ ID NO 202
atggcgatcatttatgcggtagtggcgaggggaacggtggtgctgtctgagttcagcgcggtgacgggaaacacaggagcggtggcgagacggatcctggagaagcttccatcggaagctgattcaaggctttgcttctcgcaagatcgttacatatttcacatactcagatccgatggcctcacttttctctgtatggcaaacgacaccttcggcaggaggattccgtttacgtacttggaggacattcacatgaggttcatgaaaaactatggacgagttgctcactatgcgccagcctatgcaatgaatgatgagttctcaagggtcctgcatcagcaaatggaattcttctccagcaatcctagtgctgatactctcagtcgtgtaagaggtgaagttggcgaggcaagagaaaacatcaagcacaacaatcctccaagacagtggcttgaacccaaaagaggggggaatatccgtacaattatggtagaaaacatcgagaaaatacttgagagaggtgaccgaattgagcttcttgttgacaaaacagcaacgatgcaagatggtgcatttcacttcaagaaacagtccaagggccttcgaagagctctctggatgaagaatgctaagctctttttttgttcattgatgctaaaagatttttcttactgcattaaatttctaaatttggaagttgctagagaaaacagcagtttaaggccagaaaatgtgagaagtcgaaaaaggaaaaattggcttatttccatctctagatgcaaaaagaatccatatgctctttaa

SEQ ID NO: 202 - protein, 267 aa, Populus balsamifera subsp. trichocarpa
  misc_feature: Ceres ANNOT ID no.1439702
  misc_feature: Bit score of 443.8 for HMM based on sequences of FIGURE 13.
  misc_feature (159)..(212): Pfam Name: Synaptobrevin Pfam Description: Synaptobrevin
  misc_feature: Functional Homolog Of Ceres CLONE ID no. 41543 at SEQ ID NO. 160
MAIIYAVVARGTVVLSEFSAVTGNTGAVARRILEKLPSEADSRLCFSQDRYIFHILRSDGLTFLCMANDTFGRRIPFTYLEDIHMRFMKNYGRVAHYAPAYAMNDEFSRVLHQQMEFFSSNPSADTLSRVRGEVGEARENIKHNNPPRQWLEPKRGGNIRTIMVENIEKILERGDRIELLVDKTATMQDGAFHFKKQSKGLRRALWMKNAKLFFCSLMLKDFSYCIKFLNLEVARENSSLRPENVRSRKRKNWLISISRCKKNPYAL

SEQ ID NO: 203 - DNA, 660 bp, Populus balsamifera subsp. trichocarpa
  misc_feature: Ceres ANNOT ID no.1448044
  misc_feature: Encodes the peptide sequence at SEQ ID NO 204
atggggcaacaatcattgatctatagctttgtggcaagaggaactgtgattcttgcggagtacacggagtttaaaggcaatttcactggcatcgctgcacaatgtcttcaaaaacttcccgcttccaataacaagtttacttataattgcgatggccataccttcaattacctcgttgaagatggattcacctactgcgtggttgcagttgaatccgctggcagacaaatcccaattgcctttttggagcgagttaaggaagattttaacaaaagatatggtggaggaaaagcagcaacggctgttgccaatagcctgaacagagagtttgggtccaagttgaaggagcacatgcagtattgtgtggatcatcctgaagagatcagcaagcttgcaaaagttaaggctcaggtttctgaagttaagggtgttatgatggaaaacattgagaaggttcttgatcgtggagagaagattgagctgctggtggataaaactgagaaccttcgctcacaggcacaagatttccgacaacagggaactaagatgagaagaaagatgtggattcagaatatgaagatgaaattgattgttttgggtattatcattgccttgattctcatcatagtgttatccgtgtgccatggcttcaattgttaa

SEQ ID NO: 204 - protein, 219 aa, Populus balsamifera subsp. trichocarpa
  misc_feature: Ceres ANNOT ID no.1448044
  misc_feature: Bit score of 178.2 for HMM based on sequences of FIGURE 13.
  misc_feature (127)..(215): Pfam Name: Synaptobrevin Pfam Description: Synaptobrevin
  misc_feature: Functional Homolog Of Ceres CLONE ID no. 41543 at SEQ ID NO. 160
MGQQSLIYSFVARGTVILAEYTEFKGNFTGIAAQCLQKLPASNNKFTYNCDGHTFNYLVEDGFTYCVVAVESAGRQIPIAFLERVKEDFNKRYGGGKAATAVANSLNREFGSKLKEHMQYCVDHPEEISKLAKVKAQVSEVKGVMMENIEKVLDRGEKIELLVDKTENLRSQAQDFRQQGTKMRRKMWIQNMKMKLIVLGIIIALILIIVLSVCHGFNC

SEQ ID NO: 205 - DNA, 666 bp, Populus balsamifera subsp. trichocarpa
  misc_feature: Ceres ANNOT ID no.1483370
  misc_feature: Encodes the peptide sequence at SEQ ID NO 206
atgaaccagaaatcactgatttacgcgtttgtttcacgaggaactgtgattcttgctgagttcactgaattcagcgggaatttcaattccatagcgtttcaatgtctccaaaaacttcctgctactaacaacaagtttacttacaactgcgatggtcatactttcaattacctcgccgacaatgggtttacatattgtgttgttgcggatgaatcggctggaagacaagtgcctatggcttttctggagcgtgtcaaggatgatttcgtgtcaaagtatggcggtggaaaggctgccacagcccaggccaatggtcttaacaaggaatttgggccaaaattgaaggaacatatgaagtattgtgctgatcatcctgaagagataagcaagcttgcgaaagtgaaagctcaggtttcagaagttaaaggtgtcatgatggagaacattgagaaggttctggataggggagagaaaatagaacttcttgtggacaagaccgagaaccttcattcacaggcacaagactttcgcagtcaagggacacaaatccggagaaaaatgtggctgcagaacatgaaggttaagctgattgtattgggaatactgattgccttgatcctcatcatagtcctctctgtttgcaaaggctttaattgtggaaaatga

SEQ ID NO: 206 - protein, 221 aa, Populus balsamifera subsp. trichocarpa
  misc_feature: Ceres ANNOT ID no.1483370
  misc_feature: Bit score of 183.2 for HMM based on sequences of FIGURE 13.
  misc_feature (127)..(215): Pfam Name: Synaptobrevin Pfam Description: Synaptobrevin
  misc_feature: Functional Homolog Of Ceres CLONE ID no. 41543 at SEQ ID NO. 160
MNQKSLIYAFVSRGTVILAEFTEFSGNFNSIAFQCLQKLPATNNKFTYNCDGHTFNYLADNGFTYCVVADESAGRQVPMAFLERVKDDFVSKYGGGKAATAQANGLNKEFGPKLKEHMKYCADHPEEISKLAKVKAQVSEVKGVMMENIEKVLDRGEKIELLVDKTENLHSQAQDFRSQGTQIRRKMWLQNMKVKLIVLGILIALILIIVLSVCKGFNCGK

SEQ ID NO: 207 - DNA, 660 bp, Populus balsamifera subsp. trichocarpa
  misc_feature: Ceres ANNOT ID no.1445651
  misc_feature: Encodes the peptide sequence at SEQ ID NO 208
atggggcaacaatcgttgatctatagcttcgtggctcgaggcacggtgattttggctgattacaccgatttctctggtaacttcgcgggcatagccgctcagtgtctccagaaacttcctgcaactaacaacaagttcacttacagctgcgatggccacaccttcaactacctcgtcgataacggcttcacttactgtgtagttgcagtggagtctgtggggcgacagattccgattgcctatctcgagagaatcaaggaggattttaccaacagatatggtggggggaaagctgcaatagcggttgctaatggtctgaagaaggaatttgggccgaagttgaaggagcagatgcagttttgtatggaccatccagaggaagtcagcaagcttgccaaagtgaaagctcaggtttctgaagtgaaaggagttatgatggaaaacatagagaaggttcttgatcggggagagaaaattgaacttctggtagacaaaacagaaaaccttcgctctcaggcacaagttttcaggcagcaagggggccagataaagaggaaaatgtggtggcagaacatgaaaataaagctgatagtgctggcgatcttgattgtcctgattctcatcatagtattgtctatttgtggtggcttcaaatgctga

SEQ ID NO: 208 - protein, 219 aa, Populus balsamifera subsp. trichocarpa
  misc_feature: Ceres ANNOT ID no.1445651
  misc_feature: Bit score of 172.0 for HMM based on sequences of FIGURE 13.
  misc_feature (127)..(215): Pfam Name: Synaptobrevin Pfam Description: Synaptobrevin
  misc_feature: Functional Homolog Of Ceres CLONE ID no. 41543 at SEQ ID NO. 160
MGQQSLIYSFVARGTVILADYTDFSGNFAGIAAQCLQKLPATNNKFTYSCDGHTFNYLVDNGFTYCVVAVESVGRQIPIAYLERIKEDFTNRYGGGKAAIAVANGLKKEFGPKLKEQMQFCMDHPEEVSKLAKVKAQVSEVKGVMMENIEKVLDRGEKIELLVDKTENLRSQAQVFRQQGGQIKRKMWWQNMKIKLIVLAILIVLILIIVLSICGGFKC

SEQ ID NO: 209 - protein, 340 aa, Populus balsamifera subsp. trichocarpa
  misc_feature: Ceres ANNOT ID no.1520801
  misc_feature: Bit score of 491.8 for HMM based on sequences of FIGURE 9.
  misc_feature (73)..(310): Pfam Name: Trehalose_PPase Pfam Description: Trehalose-phosphatase
  misc_feature: Functional Homolog Of Ceres SEEDLINE ID no. ME20095 at SEQ ID NO. 1129
MGFQRSSNRQKVQPGASDLSSNERAPNSCHPVINGSAVSDDANYSSWMVDHPSALTSFDQMMKDAKGKKIVVFLDYDGTLSPIVNDPDRAFMSDEMRAAVREVAKYFPTAIISGRSRDKLNNIYYAGSHGMDIMAPPRPVRSSDGKYHTVSLDRKGNEAVFQPAQKFLPSIQKILKELEEAIMKIQGARVENNRFCVSVHFRQVRDEDYGILEEKVKSILKHYPDFRLGWGKKVMEIRPSIEWDKGNALEYLLDTLGLGNCTDVLPVYIGDDRTDEDAFKVIQKRGQGYPIVVASSPKDTKASYSLHDPSEVLTFLLRLARWRKASSSSRSLSQIWGVGS

SEQ ID NO: 210 - DNA, 1020 bp, Populus balsamifera subsp. trichocarpa
  misc_feature: Ceres ANNOT ID no.1526501
  misc_feature: Encodes the peptide sequence at SEQ ID NO 139
atgggatttcagagatcttcctattggcaaaaggtgcagcctggtagtgatctttctacaaaagagacggcaccaaattcaagtcaccctgtaaccaatgaagctgtttctgatgatgcagattacagttcatggatggtggaccatccttctgcattaacctcatttgatcagatgatgaaggatgcaaaggggaagaagatcgtcgtgtttttagactatgacggtactctctcgccgattgtaaatgatcctgaccgcgctttcatgtctgatgagatgcgtgcagcagttcgagaagttgcaaaatactttccaacagctataatcagtggtagaagcagagataagttgaataatatatattatgctggaagccatgggatggacatcatggcaccacctaggccggctaggtccagtgatggaaaataccatactgtttcccttgacagaaagggcaatgatgctgtctttcaacctgctcagaaatttttgcctgcaattcaaaagattttgaaagaactggaagaggcaattatgaaaataccaggtgccagagtagagaacaacagattttgtgcctccgtacattttcgacaagttagagaggaggattatgggaccttagaggagaaggtgaagtccatacttaaacactatccagactttcgcttgggttggggtaaaaaggttatggaaatacgaccatcaatagaatgggacaaaggcaatgccctggaatatttactcgatactctagggttaggtaactgcaccgatgttctcccactttacattggagatgacataacagatgaagatgctttcaaggtaattcaaaagagaggccaaggatgtccgatcgttgtcacttccagtcccaaggatactaaagcctcatactccctgtatgaaccatcagaagtgttgacattcttgttgcgtctagcaaggtggaggaaatcctctagttcgagtaggtcagtactatctcaggtttggggtgtgagtggttga

SEQ ID NO: 211 - DNA, 660 bp, Populus balsamifera subsp. trichocarpa
  misc_feature: Ceres ANNOT ID no.1490863
  misc_feature: Encodes the peptide sequence at SEQ ID NO 212
atggggcaacaaacgttgatctatagctttgtggcaagaggaacggtgcttcttgcggagtacacggagtttaaagggaatttcacaggcatcgctgcacaatgtcttgaaaaacttcccgcgtctaataataagtttacttataattgcgatggccataccttcaattacctcgttgaaaacggattcacttactgcgtggttgcagttgaatctgctggcagacaaattccaattgcctttttggagcgagttaaggaagattttaacaaaagatacagtggaggaaaagcagcaactgctgttgccaagagcctgaacggagagtttgggtccaaattgaaggggcatatgcagtattgtgtggatcatcctgaagagatcagcaagcttgcaaaagtcaaggctcaggtctctgaagttaaaggtgttatgatggaaaacattgagaaggttcttgatcgtggtgacaagattgagctgctggtggagaaaactgagaaccttcgctcacaggcacaagatttccgacaacagggaactaagatgagaagaaagatgtggattcagaatatgaagataaaactgattgttttgggtattataattgccttgattctcatcatagtcttatctatttgtcatggattcaattgctaa

SEQ ID NO: 212 - protein, 219 aa, Populus balsamifera subsp. trichocarpa
  misc_feature: Ceres ANNOT ID no.1490863
  misc_feature: Bit score of 169.4 for HMM based on sequences of FIGURE 13.
  misc_feature (127)..(215): Pfam Name: Synaptobrevin Pfam Description: Synaptobrevin
  misc_feature: Functional Homolog Of Ceres CLONE ID no. 41543 at SEQ ID NO. 160
MGQQTLIYSFVARGTVLLAEYTEFKGNFTGIAAQCLEKLPASNNKFTYNCDGHTFNYLVENGFTYCVVAVESAGRQIPIAFLERVKEDFNKRYSGGKAATAVAKSLNGEFGSKLKGHMQYCVDHPEEISKLAKVKAQVSEVKGVMMENIEKVLDRGDKIELLVEKTENLRSQAQDFRQQGTKMRRKMWIQNMKIKLIVLGIIIALILIIVLSICHGFNC

SEQ ID NO: 213 - DNA, 642 bp, Populus balsamifera subsp. trichocarpa
  misc_feature: Ceres ANNOT ID no.1501043
  misc_feature: Encodes the peptide sequence at SEQ ID NO 214
atggggcaacaatcattgatctatagctttgtggcaagaggaactgtgattcttgcggagtacacggagtttaaaggcaatttcactggcatcgctgcacaatgtcttcaaaaacttcccgcttccaataacaagtttacttataattgcgatggccataccttcaattacctcgttgaagatggattcattgaatccgctggcagacaaatcccaattgcctttttggagcgagttaaggaagattttaacaaaagatatggtggaggaaaagcagcaacggctgttgccaatagcctgaacagagagtttgggtccaagttgaaggagcacatgcagtattgtgtggatcatcctgaagagatcagcaagcttgcaaaagttaaggctcaggtttctgaagttaagggtgttatgatggaaaacattgagaaggttcttgatcgtggagagaagattgagctgctggtggataaaactgagaaccttcgctcacaggcacaagatttccgacaacagggaactaagatgagaagaaagatgtggattcagaatatgaagatgaaattgattgttttgggtattatcattgccttgattctcatcatagtgttatccgtgtgccatggcttcaattgttaa

SEQ ID NO: 214 - protein, 213 aa, Populus balsamifera subsp. trichocarpa
  misc_feature: Ceres ANNOT ID no.1501043
  misc_feature: Bit score of 162.2 for HMM based on sequences of FIGURE 13.
  misc_feature (121)..(209): Pfam Name: Synaptobrevin Pfam Description: Synaptobrevin
  misc_feature: Functional Homolog Of Ceres CLONE ID no. 41543 at SEQ ID NO. 160
MGQQSLIYSFVARGTVILAEYTEFKGNFTGIAAQCLQKLPASNNKFTYNCDGHTFNYLVEDGFIESAGRQIPIAFLERVKEDFNKRYGGGKAATAVANSLNREFGSKLKEHMQYCVDHPEEISKLAKVKAQVSEVKGVMMENIEKVLDRGEKIELLVDKTENLRSQAQDFRQQGTKMRRKMWIQNMKMKLIVLGIIIALILIIVLSVCHGFNC

SEQ ID NO: 215 - DNA, 642 bp, Populus balsamifera subsp. trichocarpa
  misc_feature: Ceres ANNOT ID no.1527507
  misc_feature: Encodes the peptide sequence at SEQ ID NO 216
atgagccagaaatcactgatctacgcatttgtttctcgaggaactgtgattcttgctgactatactgagttcagtgggaatttcaattccatagcttttcaatgtctccagaaacttcctgctactaacaacaagtttacttacaactgtgatggccacactttcaattacctcgttgacaatggctttactgaatcggctggaagacaagtacctatagcttttctggagcgtgttaaggatgattttgtgacaaaatatggcggtggaaaggctgccacagcccaggccaacggtcttaacaaggaatttgggccaaaattgaaggaacatatgcaatattgtgctgatcatcctgaagagataagcaagcttgccaaagtgaaagctcaggtctctgaagttaagggtgtcatgatggagaacattgagaaggttttggataggggggagaaaatagaacttcttgtggacaagactgagaaccttcatcaacaggcacaagacttccgcagtcaagggacacaaatccggagaaaaatgtggctgcagaacatgaaggttaagctgattgtattgggtatactgattgtcttgatcctcatcatagtcctctctatttgcaaaggcttcaactgctga

SEQ ID NO: 216 - protein, 213 aa, Populus balsamifera subsp. trichocarpa
  misc_feature: Ceres ANNOT ID no.1527507
  misc_feature: Bit score of 160.0 for HMM based on sequences of FIGURE 13.
  misc_feature (121)..(209): Pfam Name: Synaptobrevin Pfam Description: Synaptobrevin
  misc_feature: Functional Homolog Of Ceres CLONE ID no. 41543 at SEQ ID NO. 160
MSQKSLIYAFVSRGTVILADYTEFSGNFNSIAFQCLQKLPATNNKFTYNCDGHTFNYLVDNGFTESAGRQVPIAFLERVKDDFVTKYGGGKAATAQANGLNKEFGPKLKEHMQYCADHPEEISKLAKVKAQVSEVKGVMMENIEKVLDRGEKIELLVDKTENLHQQAQDFRSQGTQIRRKMWLQNMKVKLIVLGILIVLILIIVLSICKGFNC

SEQ ID NO: 217 - DNA, 642 bp, Populus balsamifera subsp. trichocarpa
  misc_feature: Ceres ANNOT ID no.1498633
  misc_feature: Encodes the peptide sequence at SEQ ID NO 218
atggggcaacaatcgttgatctatagcttcgtggctcgaggcacggtgattttggctgattacaccgatttctctggtaacttcgcgggcatagccgctcagtgtctccagaaacttcctgcaactaacaacaagttcacttacagctgcgatggccacaccttcaactacctcgtcgataacggcttcatggagtctgtggggcgacagattccgattgcctatctcgagagaatcaaggaggattttaccaacagatatggtggggggaaagctgcaatagcggttgctaatggtctgaagaaggaatttgggccgaagttgaaggagcagatgcagttttgtatggaccatccagaggaagtcagcaagcttgccaaagtgaaagctcaggtttctgaagtgaaaggagttatgatggaaaacatagagaaggttcttgatcggggagagaaaattgaacttctggtagacaaaacagaaaaccttcgctctcaggcacaagttttcaggcagcaagggggccagataaagaggaaaatgtggtggcagaacatgaaaataaagctgatagtgctggcgatcttgattgtcctgattctcatcatagtattgtctatttgtggtggcttcaaatgctga

SEQ ID NO: 218 - protein, 213 aa, Populus balsamifera subsp. trichocarpa
  misc_feature: Ceres ANNOT ID no.1498633
  misc_feature: Bit score of 156.1 for HMM based on sequences of FIGURE 13.
  misc_feature (121)..(209): Pfam Name: Synaptobrevin Pfam Description: Synaptobrevin
  misc_feature: Functional Homolog Of Ceres CLONE ID no. 41543 at SEQ ID NO. 160
MGQQSLIYSFVARGTVILADYTDFSGNFAGIAAQCLQKLPATNNKFTYSCDGHTFNYLVDNGFMESVGRQIPIAYLERIKEDFTNRYGGGKAAIAVANGLKKEFGPKLKEQMQFCMDHPEEVSKLAKVKAQVSEVKGVMMENIEKVLDRGEKIELLVDKTENLRSQAQVFRQQGGQIKRKMWWQNMKIKLIVLAILIVLILIIVLSICGGFKC

SEQ ID NO: 219 - DNA, 717 bp, Populus balsamifera subsp. trichocarpa
  misc_feature: Ceres ANNOT ID no.1465403
  misc_feature: Encodes the peptide sequence at SEQ ID NO 220
atgagtagtcagaaaggcttgatatatagttttgtggcaaagggaaatgtggtgctagcagagcacacatcgtattcggggaactttagtaccattgctgttcagtgtttgcagaagcttccttcaaatagcagcaagtacacgtactctagtgacgggcacacatttaacttcctcattgataatggatttgtttttctcgttgttgctgatgaatcagttgggaggggtgtgtcttttgtgtttcttgagcgagtgaaggatgattttaatcagcggtatggtgccagtattaaaaatgaggcacacccactagctgatgacgacgacgatgacgacttgtttgaagaccgatttagcattgcctacaatcttgacagagaatttgggccaagactcaaggagcatatgcagtactgcgtgaaccacccagaagagatcagtaagctctccaagttaaaggctcagataacggaggtcaaggggattatgatggacaacattgataaggttttggaccgtggagagaggattgaacttttggtagataaaacagataacctctcgttccaggctgacagcttccagaggcaaggaagggaattgcgacggaagatgtggcttcagaatctgaaagtgaagttagtcctgggaggaacagtccttgccttgattgtgatcgtgtggatttccgtttgtggaggtttcaaatgttag

SEQ ID NO: 220 - protein, 238 aa, Populus balsamifera subsp. trichocarpa
  misc_feature: Ceres ANNOT ID no.1465403
  misc_feature: Bit score of 155.5 for HMM based on sequences of FIGURE 13.
  misc_feature (146)..(234): Pfam Name: Synaptobrevin Pfam Description: Synaptobrevin
  misc_feature: Functional Homolog Of Ceres CLONE ID no. 41543 at SEQ ID NO. 160
MSSQKGLIYSFVAKGNVVLAEHTSYSGNFSTIAVQCLQKLPSNSSKYTYSSDGHTFNFLIDNGFVFLVVADESVGRGVSFVFLERVKDDFNQRYGASIKNEAHPLADDDDDDDLFEDRFSIAYNLDREFGPRLKEHMQYCVNHPEEISKLSKLKAQITEVKGIMMDNIDKVLDRGERIELLVDKTDNLSFQADSFQRQGRELRRKMWLQNLKVKLVLGGTVLALIVIVWISVCGGFKC

SEQ ID NO: 221 - DNA, 717 bp, Populus balsamifera subsp. trichocarpa
  misc_feature: Ceres ANNOT ID no.1510956
  misc_feature: Encodes the peptide sequence at SEQ ID NO 222
atgagtagtcagagaggcttgatatatagtttcgtggcaaagggaaatgtggttttagcagagcacacttcatattcagggaacttcagtaccgttgctgttcagtgtttacagaagctcccttccaatagcagcaagtacacgtactcttgtgatgggcacacgtttaacttcctcattgataatggatttgtttttcttgctgttgcagatgaatcggctgggaggggtttgccttttgtatttcttgaacgagtgaaggatgattttaaacagcggtatagcgccagtattaaaaatgaggcacacccactagctgatgacgatgatgatgacgacttgtttgaagaccgatttagcgtcgcctacaatcttgacagggagtttgggccaagactaaaggagcatatgcagtactgcttgaaccacccagaagagatcagtaagctatccaagttaaaggctcagatcacggaggtcaagggtattatgatggacaacattgaaaaggttttggaccgtggagagaggattgaacttctggtagataaaacagaaaacctccagttccaggctgacagcttccagaggcaaggaaggcaattgcgacggaagatgtggcttcagaatctccaaatgaagttgatggtgggaggaggagtccttgtcgtaattctgatcctgtggtttgttgcttgtggaggtttcaaatgttag

SEQ ID NO: 222 - protein, 238 aa, Populus balsamifera subsp. trichocarpa
  misc_feature: Ceres ANNOT ID no.1510956
  misc_feature: Bit score of 151.7 for HMM based on sequences of FIGURE 13.
  misc_feature (146)..(234): Pfam Name: Synaptobrevin Pfam Description: Synaptobrevin
  misc_feature: Functional Homolog Of Ceres CLONE ID no. 41543 at SEQ ID NO. 160
MSSQRGLIYSFVAKGNVVLAEHTSYSGNFSTVAVQCLQKLPSNSSKYTYSCDGHTFNFLIDNGFVFLAVADESAGRGLPFVFLERVKDDFKQRYSASIKNEAHPLADDDDDDDLFEDRFSVAYNLDREFGPRLKEHMQYCLNHPEEISKLSKLKAQITEVKGIMMDNIEKVLDRGERIELLVDKTENLQFQADSFQRQGRQLRRKMWLQNLQMKLMVGGGVLVVILILWFVACGGFKC

SEQ ID NO: 223 - DNA, 1569 bp, Populus balsamifera subsp. trichocarpa
  misc_feature: Ceres ANNOT ID no.1457735
  misc_feature: Encodes the peptide sequence at SEQ ID NO 224
atgagtagtcagagaggcttgatatatagtttcgtggcaaagggaaatgtggttttagcagagcacacttcatattcagggaacttcagtaccgttgctgttcagtgtttacagaagctcccttccaatagcagcaagtacacgtactcttgtgatgggcacacgtttaacttcctcattgataatggatttgtttttcttgctgttgcagatgaatcggctgggaggggtttgccttttgtatttcttgaacgagtgaaggatgattttaaacagcggtatagcgccagtattaaaaatgaggcacacccactagctgatgacgatgatgatgacgacttgtttgaagaccgatttagcgtcgcctacaatcttgacagggagtttgggccaagactaaaggagcatatgcagtactgcttgaaccacccagaagagatcagtaagctatccaagttaaaggctcagatcacggaggtcaagggtattatgatggacaacattgaaaaggttttggaccgtggagagaggattgaacttctggtagataaaacagaaaacctccagttccaggctgacagcttccagaggcaaggaaggcaattgcgacggaagatgtggcttcagaatctccaaatgaagttgatggtgggaggaggagtccttgtcgtaattctgatcctgtggtttatcttgtttgggagtgtaagtttatgtctatctctcatggaacacgaggaagaacttgtattggaaaatgtagactccgatacaatagtgcaatcttatgatttgtgcttggccggacgcttcctcacagacagatctatcaattttaatgctacgaggaacaaagtggcaaggctttggcgtccaggcaggggtatgtgcaccagggaactcagcgacagcaagtacttgattcaattttttcacagtgtggatatgaaaagggttcttgagggggctccctgggcgtttgacaatcatttgcttttgttgcatcgacttgttgaaggtgatgtcccacgtcaaatccctgttaaccatgttgatttttgggtccaaatttatgagcttcaagtgggttatatgtccttagttataggcaagcaactgggtgactttattggtacctttgttgattatgataccatcaacaacaatggagctcggaggagctacatgaggattagggtcacaattgatggtcaccaccctttgaagaaaatacgcaagggagaaggctcctcgtatatggtccagttcaaatatgaaagacttggtcatgcagatagattttgtaagcatttgtttgagatgcatgagagggagggattgggggacatggttaagggcgtcggcaaggagaagctccggcgaggatggtggtcgatggctgcgggaggatgccgcgatcaattagcaactctcctagcccaagaggaggcatattggaggcagcgagcaaagctactatggttgaaggagggtgatttgaataccaagtatttccatgagatggcttctagtaaaagaaagtgcaacatgctgacttacgctgattaa

SEQ ID NO: 224 - protein, 522 aa, Populus balsamifera subsp. trichocarpa
  misc_feature: Ceres ANNOT ID no.1457735
  misc_feature: Bit score of 150.3 for HMM based on sequences of FIGURE 13.
  misc_feature (146)..(234): Pfam Name: Synaptobrevin Pfam Description: Synaptobrevin
  misc_feature: Functional Homolog Of Ceres CLONE ID no. 41543 at SEQ ID NO. 160
MSSQRGLIYSFVAKGNVVLAEHTSYSGNFSTVAVQCLQKLPSNSSKYTYSCDGHTFNFLIDNGFVFLAVADESAGRGLPFVFLERVKDDFKQRYSASIKNEAHPLADDDDDDDLFEDRFSVAYNLDREFGPRLKEHMQYCLNHPEEISKLSKLKAQITEVKGIMMDNIEKVLDRGERIELLVDKTENLQFQADSFQRQGRQLRRKMWLQNLQMKLMVGGGVLVVILILWFILFGSVSLCLSLMEHEEELVLENVDSDTIVQSYDLCLAGRFLTDRSINFNATRNKVARLWRPGRGMCTRELSDSKYLIQFFHSVDMKRVLEGAPWAFDNHLLLLHRLVEGDVPRQIPVNHVDFWVQIYELQVGYMSLVIGKQLGDFIGTFVDYDTINNNGARRSYMRIRVTIDGHHPLKKIRKGEGSSYMVQFKYERLGHADRFCKHLFEMHEREGLGDMVKGVGKEKLRRGWWSMAAGGCRDQLATLLAQEEAYWRQRAKLLWLKEGDLNTKYFHEMASSKRKCNMLTYAD

SEQ ID NO: 225 - protein, 219 aa, Arabidopsis thaliana
  misc_feature: Public GI ID no.15224711
  misc_feature: Bit score of 603.9 for HMM based on sequences of FIGURE 13.
  misc_feature (123)..(211): Pfam Name: Synaptobrevin Pfam Description: Synaptobrevin
  misc_feature: Functional Homolog Of Ceres CLONE ID no. 41543 at SEQ ID NO. 160
MSILYALVARGTVVLAELSTTSTNASTIAKQILEKIPGNGDSHVSYSQDRYVFHVKRTDGLTVLCMADEDAGRRIPFSFLEDIHQRFVRTYGRAIHSAQAYAMNDEFSRVLNQQIEYYSNDPNADTISRIKGEMNQVRDVMIENIDNILDRGERLELLVDKTANMQGNTFRFRKQTRRFNNTVWWRNCKLTLLLILVLLVIIYIGVAFACHGPTLPSCV

SEQ ID NO: 226 - DNA, 1197 bp, Populus balsamifera subsp. trichocarpa
  misc_feature: Ceres ANNOT ID no.1520801
  misc_feature: Encodes the peptide sequence at SEQ ID NO 209
atgggagctagctatctcttggtttggtttgtgaggcctggatgtttacatgttaaaaaggatgcatgtcagaagaacgttttgagcgacactccaaaacccactcctcatcagtcattctcatcttggtatcttgatatgtttaagagaaattttgcaaagcttaaccaggccatgggatttcaaagatcttccaacaggcaaaaggtgcagcctggtgctagtgatctctcttcaaatgagagagcaccaaattcgtgtcatcctgtaatcaatggatcagctgtttctgatgatgcaaattacagttcatggatggtggaccatccttctgcattgacctcatttgatcagatgatgaaagatgcaaaggggaagaagatcgtcgtgtttttagactacgacggaactctctcgccgattgtaaatgatcctgatcgtgctttcatgtctgatgagatgcgtgcagcagttcgtgaagttgcaaaatactttccaacagctataatcagtggtagaagcagagataagttgaataacatatattatgctggaagccatgggatggacattatggcaccacctaggcctgttaggtctagtgatgggaaatatcatactgtatcccttgacagaaagggcaatgaagctgtctttcaacctgctcagaaattcttaccttcaattcaaaagattctgaaagaactggaagaggcaattatgaaaatacaaggtgccagggtagaaaacaacagattttgtgtctctgtacattttcgacaagttcgagatgaggattatgggatcttagaggagaaggtgaagtctattctgaaacactatccagactttcgtttgggttggggtaagaaggttatggaaatacgaccatcaatagaatgggacaaaggcaacgccctagaatatttgctcgatactctagggttaggcaactgcaccgatgttctcccggtttatatcggagatgaccggacagatgaagatgctttcaaggtgattcaaaagagaggccaagggtatccaatcgtggtagcgtccagtccgaaggatacgaaagcttcctactccctccatgacccgtcggaagtcttgactttcttgctgcgtctagcaaggtggaggaaggcctctagttcgagcaggtcactgtctcagatctggggtgtgggtagctaa

SEQ ID NO: 227 - DNA, 1121 bp, Arabidopsis thaliana
  misc_feature: Ceres CLONE ID no.40062
  misc_feature: Encodes the peptide sequence at SEQ ID NO 228
gtagggttcctcaaaatcatttcaataattcaatttcagatgtatggtgatgcttctttgattacaaatcggcgttgaacaattctccgattttacactctaatcgaatcactttggggtgttttgttaatcgctgttctcaagatctgagatttacagggagaagtgagctggaacaaggtgccggagtagatggcgatcatatttgcgttggtggctcgtggaacggtggtgttatcggagtttagcgctacttcgactaacgctagctcaatctcgaagcagattttggagaagttgcctggaaacgatagcgatagccatatgtcttactctcaggatcgctacatcttccatgtgaaacgaacagatggtcttaccgttctctgtatggccgacgaaaccgccggaaggaatattccgtttgcgtttttggatgatattcatcagaggtttgtgaaaacatatggccgagctattcattcagctcaagcttattccatgaatgatgaattttcaagagttctgagtcaacagatggagttttattccaatgatcctaatgcagacaggatgagcagaatcaaaggtgaaatgagtcaggttcgaaatgtgatgattgagaatattgataaagttttggatagaggggagcgtttggagttgctagttgataaaaccgaaaatatgcaaggcaacacttttcgtttcagaaagcaagctcgtcgttacagaaccattatgtggtggagaaatgtcaagcttacaattgctctgatacttgtactagctttggttgtgtacatcgcgatggcctttgtttgccatgggccaagtcttccttcttgtttcaagtaagaagacattctcttatcttcttcacctttcccttcttgggaattatcagactctgcttcgattttggaatgtgagattatatgcgtttgtctaaaatgtgtgtttatgtgatctttcaatttcagcttctgcttattgctttgaattacagagtcgattatttatttgtaagtgtgatatttcactgttaatgatcatcccctgtctgtttgcaatttatgctgcggcgttaaaagttgtattaaatgatgacgtttttagcc

SEQ ID NO: 228 - protein, 221 aa, Arabidopsis thaliana
  misc_feature: Ceres CLONE ID no.40062
  misc_feature: Bit score of 603.2 for HMM based on sequences of FIGURE 13.
  misc_feature (124)..(212): Pfam Name: Synaptobrevin Pfam Description: Synaptobrevin
  misc_feature: Functional Homolog Of Ceres CLONE ID no. 41543 at SEQ ID NO. 160
MAIIFALVARGTVVLSEFSATSTNASSISKQILEKLPGNDSDSHMSYSQDRYIFHVKRTDGLTVLCMADETAGRNIPFAFLDDIHQRFVKTYGRAIHSAQAYSMNDEFSRVLSQQMEFYSNDPNADRMSRIKGEMSQVRNVMIENIDKVLDRGERLELLVDKTENMQGNTFRFRKQARRYRTIMWWRNVKLTIALILVLALVVYIAMAFVCHGPSLPSCFK

SEQ ID NO: 229 - protein, 220 aa, Arabidopsis thaliana
  misc_feature: Public GI ID no.15220315
  misc_feature: Bit score of 165.7 for HMM based on sequences of FIGURE 13.
  misc_feature (127)..(215): Pfam Name: Synaptobrevin Pfam Description: Synaptobrevin
  misc_feature: Functional Homolog Of Ceres CLONE ID no. 41543 at SEQ ID NO. 160
MGQQSLIYSFVARGTVILAEYTEFKGNFTSVAAQCLQKLPSSNNKFTYNCDGHTFNYLADNGFTYCVVVIESAGRQIPMAFLERVKEDFNKRYGGGKASTAKANSLNKEFGSKLKEHMQYCADHPEEISKLSKVKAQVTEVKGVMMENIEKVLDRGEKIELLVDKTENLRSQAQDFRTQGTKMKRKLWFENMKIKLIVFGIIVALILIIILSVCHGFKCT

SEQ ID NO: 230 - DNA, 909 bp, Arabidopsis thaliana
  misc_feature: Ceres CLONE ID no.36480
  misc_feature: Encodes the peptide sequence at SEQ ID NO 231
gttttgttctttcatagtcttctagatctgtagtttttttccgcgaccgcccaaaaaattctctgatcagacggtcgattggatcggagatttaaggtaaagaaaaaatggcgcaacaatcgttgatctacagttttgtagctcgcggcacggtgatcctcgttgagttcactgatttcaaaggtaatttcacctcaatcgctgctcagtgcctccagaagcttccgtcttcgaacaacaagttcacctacaactgcgacggtcataccttcaattaccttgtcgaagatggattcacctattgtgttgttgcggttgattctgctgggaggcaaattcccatgtcctttttggaaagagtaaaagaagattttaacaagcgatatggtggtggaaaagctgcaactgctcaagcaaacagcttgaataaggagtttggctctaaactgaaagagcatatgcagtattgcatggatcatcctgatgagattagcaagcttgctaaggtgaaggcgcaagtgtcagaagttaagggtgtaatgatggaaaacattgagaaggttcttgaccgtggtgagaaaattgagcttttggtggacaaaaccgaaaatcttcgctcacaggcacaagatttcagaacaacaggaacgcagatgagaagaaagatgtggcttcagaacatgaagataaaactcatagtgctcgccatcattatcgcactgattctcatcatcgtgctctcagtttgccatgggtttaagtgttaagcccagaaaattcaaaacttctgagatctttctcactcggtacatcgtagtgccttctcttttattgttcgatcttcaatctaatgtttctgcttgaattggttttgtatagatagacatatatgtatgctactcatttgct

SEQ ID NO: 231 - protein, 219 aa, Arabidopsis thaliana
  misc_feature: Ceres CLONE ID no.36480
  misc_feature: Bit score of 170.8 for HMM based on sequences of FIGURE 13.
  misc_feature (127)..(215): Pfam Name: Synaptobrevin Pfam Description: Synaptobrevin
  misc_feature: Functional Homolog Of Ceres CLONE ID no. 41543 at SEQ ID NO. 160
MAQQSLIYSFVARGTVILVEFTDFKGNFTSIAAQCLQKLPSSNNKFTYNCDGHTFNYLVEDGFTYCVVAVDSAGRQIPMSFLERVKEDFNKRYGGGKAATAQANSLNKEFGSKLKEHMQYCMDHPDEISKLAKVKAQVSEVKGVMMENIEKVLDRGEKIELLVDKTENLRSQAQDFRTTGTQMRRKMWLQNMKIKLIVLAIIIALILIIVLSVCHGFKC

SEQ ID NO: 232 - DNA, 1120 bp, Arabidopsis thaliana
  misc_feature: Ceres CLONE ID no.2443
  misc_feature: Encodes the peptide sequence at SEQ ID NO 233
aaaactcaagggtttgatttttcttcttcaactacgttaagatttctcctacacttttctttttcaccgtattctcttttagtcctcgattctctacgcgtttcagcgtcaagtcttctagatctctaaagccttcgtgctcgccaatataaatctctgagatcggtcccgtaaaatcggattcgcgtcgtttttgagtaaaaaaaatggcgcaacaatcgttgatctacagtttcgtcgctcgtggtaccgttatcctcgttgagttcacagatttcaaaggcaatttcacatcaatcgctgctcagtgccttcagaagcttccttcttctaacaacaagtttacctacaactgcgatggtcacacgttcaattacctcgtcgaaaatggattcacctattgtgttgttgcagttgattctgctgggaggcagattcctatggctttcttggaacgagttaaggaggatttcaacaagagatatggtggtggaaaggctgcaactgctcaagcaaacagcttgaataaagaatttgggtcgaaactgaaagagcatatgcagtattgcatggatcatcctgatgagattagcaagcttgctaaggttaaagctcaagtgtctgaagttaaaggtgttatgatggaaaacattgagaaggttcttgaccgtggtgagaagattgagcttttggttgacaaaacagaaaaccttcgctcacaggcgcaagattttagaacacaaggaactcaaatgagaagaaagatgtggtttcagaacatgaagataaagctcattgtccttgcaattatcattgccttgattctcatcatcatcctctcaatttgtgggggattcaactgcggtaaataagtctggaacatttcttcccggcgttatcgactgcgctctgtgcttcccaagatctctgagaatatcttcattcagttcgttgtgctaccttttttttgtttttgtttttgtgatttctatattctcatactatatgtttcttcttagattgtacttcttgaaatttgttttgtataggctatatatattatacatatatgtatgcatgttcgacaatctgcaatgttgctattgctggtactgacact

SEQ ID NO: 233 - protein, 221 aa, Arabidopsis thaliana
  misc_feature: Ceres CLONE ID no.2443
  misc_feature: Bit score of 174.7 for HMM based on sequences of FIGURE 13.
  misc_feature (127)..(215): Pfam Name: Synaptobrevin Pfam Description: Synaptobrevin
  misc_feature: Functional Homolog Of Ceres CLONE ID no. 41543 at SEQ ID NO. 160
MAQQSLIYSFVARGTVILVEFTDFKGNFTSIAAQCLQKLPSSNNKFTYNCDGHTFNYLVENGFTYCVVAVDSAGRQIPMAFLERVKEDFNKRYGGGKAATAQANSLNKEFGSKLKEHMQYCMDHPDEISKLAKVKAQVSEVKGVMMENIEKVLDRGEKIELLVDKTENLRSQAQDFRTQGTQMRRKMWFQNMKIKLIVLAIIIALILIIILSICGGFNCGK

SEQ ID NO: 234 - protein, 220 aa, Arabidopsis thaliana
  misc_feature: Public GI ID no.30685375
  misc_feature: Bit score of 165.9 for HMM based on sequences of FIGURE 13.
  misc_feature (127)..(215): Pfam Name: Synaptobrevin Pfam Description: Synaptobrevin
  misc_feature: Functional Homolog Of Ceres CLONE ID no. 41543 at SEQ ID NO. 160
MGQQNLIYSFVARGTVILVEYTEFKGNFTAVAAQCLQKLPSSNNKFTYNCDGHTFNYLVENGFTYCVVAVESVGRQIPMAFLERVKEDFNKRYGGGKATTAQANSLNREFGSKLKEHMQYCVDHPDEISKLAKVKAQVTEVKGVMMENIEKVLDRGEKIELLVDKTENLRSQAQDFRTQGTKIRRKMWFENMKIKLIVLGIIITLILIIILSVCGGFKCT

SEQ ID NO: 235 - protein, 221 aa, Brassica juncea
  misc_feature: Public GI ID no.126009434
  misc_feature: Bit score of 539.0 for HMM based on sequences of FIGURE 13.
  misc_feature (124)..(212): Pfam Name: Synaptobrevin Pfam Description: Synaptobrevin
  misc_feature: Functional Homolog Of Ceres CLONE ID no. 41543 at SEQ ID NO. 160
MAIIYAVVARGTVVLAEFSAVTGNTDAVVRRILEKLSPETADERLCFSQDRYIFHILRSDGLTFLCMANDTFGRRIPFSYLEEIQMRFMKNYGKVAHQAPAYAMNDEFSRVLHQQMEFFSSNPSVDTLNRVRGEVSEIRSVMVDNIEKIMERGDRIELLVDKTATMQDSAFHFRKQSKRLRRALWMKNAKLLVMLTCVIVLVLYIIIASFCGGITLPSCRS

SEQ ID NO: 236 - DNA, 1010 bp, Brassica napus
  misc_feature: Ceres CLONE ID no.965753
  misc_feature: Encodes the peptide sequence at SEQ ID NO 237
atttcttttcaccgtctctctctctttctcatttagtctctacgcgtttcagcgttaaagtctttttctagatctcctctaccttcacgccgatataacaaaactctctgatcagtcaatagaaacccaccaatagagagagagaacacaaaaaaaaaaaaatggcgcagcaacaacaatcgctgatctacagtttcgtggctcgagggacggtgatcctcgtcgagttcaccgatttcaaaggcaatttcacatccatcgctgcacagtgcctccagaagcttccttcctccaacaacaagttcacctacaactgcgatggtcacaccttcaattacttggttgaaaatggattcacttattgtgttgttgcagttgattcagctgggaggcagattcctatggccttcttggagcgagttaaggatgatttcamcaagagatacggtggtgggaaggcagcaactgctcaagcgaacagcttgaataaggagtttgggtcgaaactgaaagagcacatgcagtattgtatggatcatcctgatgagattagcaagcttgctaaggtgaaagctcaagtttctgaagttaaaggtgtcatgatggaaaacattgagaaggttcttgmccgtggtgagaaaattgaacttttggtggacaaaaccgaaaaccttcgctcacaggsgcaagacttcagaacmcaaggaacacaaatgagaagaaagatgtggtttcagaacatgaagataaagctcattgttcttgcaatcatcatcgccttgatcctcatcatcgtcctctcagtctgcggtggcttcaactgtggcaaataagtctgggaacatttctgattcccgagaacatcctcattcagttcgttgtgctggtttttttctttttgtggtttaaaaattctcatggctatgtttcttctctgcttagatttgtacttctttaaattggttttgtataggtcatatatatatgtttgaaattgattcttgcgaacc

SEQ ID NO: 237 - protein, 223 aa, Brassica napus
  misc_feature: Ceres CLONE ID no.965753
  misc_feature: Bit score of 169.4 for HMM based on sequences of FIGURE 13.
  misc_feature (129)..(217): Pfam Name: Synaptobrevin Pfam Description: Synaptobrevin
  misc_feature: Functional Homolog Of Ceres CLONE ID no. 41543 at SEQ ID NO. 160
  misc_feature (92)..(92): Xaa is any aa, unknown, or other
  misc_feature (156)..(156): Xaa is any aa, unknown, or other
  misc_feature (175)..(175): Xaa is any aa, unknown, or other
  misc_feature (180)..(180): Xaa is any aa, unknown, or other
MAQQQQSLIYSFVARGTVILVEFTDFKGNFTSIAAQCLQKLPSSNNKFTYNCDGHTFNYLVENGFTYCVVAVDSAGRQIPMAFLERVKDDFXKRYGGGKAATAQANSLNKEFGSKLKEHMQYCMDHPDEISKLAKVKAQVSEVKGVMMENIEKVLXRGEKIELLVDKTENLRSQXQDFRXQGTQMRRKMWFQNMKIKLIVLAIIIALILIIVLSVCGGFNCGK

SEQ ID NO: 238 - DNA, 810 bp, Brassica napus
  misc_feature: Ceres CLONE ID no.948834
  misc_feature: Encodes the peptide sequence at SEQ ID NO 239
aaaaaataaagatcccaaaactctctctcttctctctgagccgactcggtgggcgactcaatgggtcagggatcgttcatctacagcttcgtcgcgagaggcactatggtcctggccgagtacaccgagttcacgggcaacttcccgtcgatagcagctcagtgtctgcagaagcttccttcctccagcaacagcaagttcacttacaactgcgatcaccacaccttcaacttcctcgtcgaagacggcttcgcatattgtgttgtggcgaaagatgctcttagcaagcaaatctcgattgcatttctggagcgggtgaaagctgatttcaagaaaaggtatgggggcggaaaagcaagtacagctatccccaaaagtctcaacaaggagttcgggccggtgatgaaagaacacatgaagtatattgttgaccatgcagaggagattgaaaagctaattaaagtcaaggctcaagtttcagaagtcaaaagtataatgttggagaatattgacaaggcaatcgacagaggagaaaatctgacggttcttactgacaagaccgagaatctacgctctcaggcgcaagagtacaagaaacaagggacacaagtgaggaggaaactgtggtaccagaacatgaagataaaacttgtggttctcgggatcttgctactacttgttctcattatctggctttcggtttgtcacgggtttaattgcacagattgaagacatyttcagaatgtgatgttagagcctctggtgaggaatggtgtgtctgagacagaagtctccggtagaggggtaggg

SEQ ID NO: 239 - protein, 222 aa, Brassica napus
  misc_feature: Ceres CLONE ID no.948834
  misc_feature: Bit score of 139.1 for HMM based on sequences of FIGURE 13.
  misc_feature (128)..(216): Pfam Name: Synaptobrevin Pfam Description: Synaptobrevin
  misc_feature: Functional Homolog Of Ceres CLONE ID no. 41543 at SEQ ID NO. 160
MGQGSFIYSFVARGTMVLAEYTEFTGNFPSIAAQCLQKLPSSSNSKFTYNCDHHTFNFLVEDGFAYCVVAKDALSKQISIAFLERVKADFKKRYGGGKASTAIPKSLNKEFGPVMKEHMKYIVDHAEEIEKLIKVKAQVSEVKSIMLENIDKAIDRGENLTVLTDKTENLRSQAQEYKKQGTQVRRKLWYQNMKIKLVVLGILLLLVLIIWLSVCHGFNCTD

SEQ ID NO: 240 - protein, 194 aa, Pyrus pyrifolia
  misc_feature: Public GI ID no.33347409
  misc_feature: Bit score of 117.1 for HMM based on sequences of FIGURE 13.
  misc_feature (127)..(194): Pfam Name: Synaptobrevin Pfam Description: Synaptobrevin
  misc_feature: Functional Homolog Of Ceres CLONE ID no. 41543 at SEQ ID NO. 160
MGQQSLIYSFVARGTVILAEYTEFTGNFTSIASQCLQKLPATNNKFTYNCDGHTFNYLVDNGFTYCVVAVEAVGRQVPIAFLERIKEDFTGRYGGGKAATAVANSLNKEFGSKLKEHMQYCVDHPEEISKLSKVKAQVSEVKGVMMENIEKVLDRGEKIELLVDKTENLRSQAQDFRQQGTQMRRKMWLQNMKL

SEQ ID NO: 241 - DNA, 1255 bp, Glycine max
  misc_feature: Ceres CLONE ID no.470694
  misc_feature: Encodes the peptide sequence at SEQ ID NO 242
aaagaagaaagtgacagtggatgaacagaagaagaagaagaaaagggttttgtgtgtgtcgaagtggatagttccttccttcaattaatctccgatccgaaaccgaatggggattctgtacgcgctggttggtcgtggatcggtggtgctggcggagttcagcggcaccaccaccaacgccagcgcaatcgcgcgtcagatccttgaaaaaatccccggcaacaacgacacgcacgtttcttactctcaggatcgctacatcttccatgttaaacgcaccgatggactcaccgttctctgcatggccgacgacaccgccggaaggcgaattccttttgcgtttcttgaggatattcatcagaagttcgtgcggacttacggacgcgccgttcactccgctcagccttacgggatgaacgaggagttctctagggttttgagtcagcaaatggagtattactccagtgatcctaacgccgataggatcaatcgtctcaaaggtgaaatgtctcaggtacggaatgtcatgatagaaaatattgacaaagttttagatagaggtgatcggttggaattgctggtcgataaaactgctaatatgcaaggaaacacatttcgcttcaggaaacaagctcgtcgcttcagaagcactgtttggtggagaaatgtcaagcttacgattgcacttatagtcgtcctactagtgatagtttatgttgtattggcatttgtttgccatgggcctgcgctaccatcttgtttttaagtgaaggattggcaagtgaattttatgtgtgctttcttgtcttcttcagcttgcagaggtcacttcttttttatctgccattgttatgcagactcccatttcttcaacttaatttctgggttgtccacttttgtgctagtaaatttcttgtaatagattcaagtgttttgggttgtatttttcattatgagacttgaggggcaaaaaaaaaactattgtatcatgttatttattgtattctcctaccagcccaaagatttggattgaaccagaaaatggctgagattttgattgatgtatagtgttgcagcgtgaggttgtcaacgtgccatggatgttctcttgttcaagagggagaagggtaaaccttaaattccatttgtcccttcatagcttagtgaagggagattttatactgctcggccaggttctcttgtccagttgatgcatgtgaaccgcataagcttaatgtatatattcttaaatttg

SEQ ID NO: 242 - protein, 219 aa, Glycine max
  misc_feature: Ceres CLONE ID no.470694
  misc_feature: Bit score of 659.0 for HMM based on sequences of FIGURE 13.
  misc_feature (123)..(211): Pfam Name: Synaptobrevin Pfam Description: Synaptobrevin
  misc_feature: Functional Homolog Of Ceres CLONE ID no. 41543 at SEQ ID NO. 160
MGILYALVGRGSVVLAEFSGTTTNASAIARQILEKIPGNNDTHVSYSQDRYIFHVKRTDGLTVLCMADDTAGRRIPFAFLEDIHQKFVRTYGRAVHSAQPYGMNEEFSRVLSQQMEYYSSDPNADRINRLKGEMSQVRNVMIENIDKVLDRGDRLELLVDKTANMQGNTFRFRKQARRFRSTVWWRNVKLTIALIVVLLVIVYVVLAFVCHGPALPSCF

SEQ ID NO: 243 - DNA, 1051 bp, Glycine max
  misc_feature: Ceres CLONE ID no.643614
  misc_feature: Encodes the peptide sequence at SEQ ID NO 244
atcttttgatttgataacaacaacctcgttgtggttttccaatgctgcgaagtcgaagatctagctagaggcagagaacgttctccctaatcttctgccgatggcgatcttctacgctttggtggccagaggcaccgtcgtcctggcggagttcagcgccgtcaccggcaacaccggcgccgtctcccgccgcatcctcgagaagcttccggcggagtccgactccaggctctgcttctctcaggatcgctacatcttccacatactccgatcggatggcatcacctacgtctgtatggccaacgacaccttcggaaggagaattcctttctcgtacttggaagatatccaaatgaggtttatgaagaactacagtagagttgccaattatgcaccagcttatgcaatgaatgatgaattttcaagggttttgcatcagcagatggaatttttttctagtaatacgagtgccgataccctcaatcgtgtgaggggagaagttggtgagatacgcactatcatggtggacaatattgagaaaatattggagagaggtgaccggattgagcttcttgttgataaaacagcaacaatgcaagacagtgcatttcactttaggaaacagtcaaagcgccttcgaagagctctttggatgaaaaattttaaactcctggccttattgacatgcttgattgttgttgttctttatttaataatcgctgcttgttgtggaggcatctctctaccgtcctgcagatcctaattgtcactcttgccagtttatttgttttctgagctctgcaactatcaagatcgtacgataagcattggacgacacttaagtattccagattcaaatttatgagctgagtggataaatttgataaaggattcagaaactgttacatgtatttgcttgtttatgtcgtttttggttctgtattatagaagttcgcgctgcagtctgataagatactattctatgattatgggccatccttctgtaaatgtggatttttatttttcataatcaaagttaaaattgtttttt

SEQ ID NO: 244 - protein, 220 aa, Glycine max
  misc_feature: Ceres CLONE ID no.643614
  misc_feature: Bit score of 536.8 for HMM based on sequences of FIGURE 13.
  misc_feature (123)..(211): Pfam Name: Synaptobrevin Pfam Description: Synaptobrevin
  misc_feature: Functional Homolog Of Ceres CLONE ID no. 41543 at SEQ ID NO. 160
MAIFYALVARGTVVLAEFSAVTGNTGAVSRRILEKLPAESDSRLCFSQDRYIFHILRSDGITYVCMANDTFGRRIPFSYLEDIQMRFMKNYSRVANYAPAYAMNDEFSRVLHQQMEFFSSNTSADTLNRVRGEVGEIRTIMVDNIEKILERGDRIELLVDKTATMQDSAFHFRKQSKRLRRALWMKNFKLLALLTCLIVVVLYLIIAACCGGISLPSCRS

SEQ ID NO: 245 - DNA, 1067 bp, Glycine max
  misc_feature: Ceres CLONE ID no.1049362
  misc_feature: Encodes the peptide sequence at SEQ ID NO 246
gacccttcttcttgttattccacttgcgttaggtttctactttcttctctctctctctctctctcttcattcctcatttttccctcaaacaatcaatcaattttcattcagattcgtaaatttctcgattagatcacggggttaggtctcccactttatcttttcccaagcctttctctttccccctttccctgtctgccccataaaattcaggatcggaaacgaactgggttcttgaatttcactctagattttgacaaattcgaagtgtgcatgcactgatgcgacccactcccccttttttgcattaaacaattatgaattgaggtattggtgtgattgtttgtaccatccggtggtggagcttgttggaaattggagatgagtcagaggggtttaatatatagctttgttgccaaaggaactgttgttttagcagagcacacgcaatataccgggaatttcagtaccattgccgttcagtgcctgcagaagctgccatcaaatagcagcaaatacacgtattcctgtgatggtcacaccttcaatttcctcctagacaatggatttgttttccttgttgttgctgatgaatcgattggcaggagtgttccttttgtatttcttgaacgggtgaaggatgactttatgaagcgctatggtgctagcattaagaatgacggtgcccatccacttgccgatgatgaggacgatgacgatttgtttgaggacagatttagcattgcatataatcttgacagagaatttggaccagcactcaaggagcatatgcagtattgcatgaaccatccagaagaaatgagtaaactatcaaaattgaaggctcaaataactgaggtcaaggggataatgatggacaatattgagaaggttttggatcgtggagagaagattgaactgctggtggacaaaacagaaaacttacagttccaggctgacagcttccagaggcagggcaggcagctgagaaggaagatgtggctgcagaatctccaaatgaagctgatggtgggaggaggaatccttatcttaattataattctgtg

SEQ ID NO: 246 - protein, 228 aa, Glycine max
  misc_feature: Ceres CLONE ID no.1049362
  misc_feature: Bit score of 139.7 for HMM based on sequences of FIGURE 13.
  misc_feature (146)..(227): Pfam Name: Synaptobrevin Pfam Description: Synaptobrevin
  misc_feature: Functional Homolog Of Ceres CLONE ID no. 41543 at SEQ ID NO. 160
MSQRGLIYSFVAKGTVVLAEHTQYTGNFSTIAVQCLQKLPSNSSKYTYSCDGHTFNFLLDNGFVFLVVADESIGRSVPFVFLERVKDDFMKRYGASIKNDGAHPLADDEDDDDLFEDRFSIAYNLDREFGPALKEHMQYCMNHPEEMSKLSKLKAQITEVKGIMMDNIEKVLDRGEKIELLVDKTENLQFQADSFQRQGRQLRRKMWLQNLQMKLMVGGGILILIIIL

SEQ ID NO: 247 - DNA, 1090 bp, Glycine max
  misc_feature: Ceres CLONE ID no.546675
  misc_feature: Encodes the peptide sequence at SEQ ID NO 248
gactttcaaacgaagaaaaagaagaaaccaaacgcggccaagttgctgatataaagcaactcaagcaagtagactaaaagctctctctctctctctctgcttccgagttccgagttgcgagttgcagagagagcaatgagtcaggaatcgtttatatatagcttcgtggctcgggggacgatggtgttagccgagtacaccgagttcactgggaacttccctgcaattgcagctcagtgcctccagaaactaccctcttccaataacaagttcacctacaattgcgaccaccacaccttcaattttctcgtcgaagacggttacgcttactgtgttgttgccaaggaatctgttagcaaacaaatctctattgctttccttgaacgtgtaaaagcggactttaagaaaagatatggtggtggaaaggcagacacggctgttgccaaaagtctcaacaaggagtttggaccagttatgaaagagcacatgaagtatatcatagaccatgctgaagagattgaaaagctaataaaagtgaaggctcaagtttcagaagttaaaagtattatgttagagaacattgataaggccattgatagaggagaaaatctaactattctggcggmcaagacagagactttgcactcacaagcccaggaattcaaaaagcaaggaactcatgtccgtcggaagatgtggtatcagaacacgaaaatcaaattggttgttcttggaattttgttgcttttggtcctggttatctggctttctgtttgccatggattcaactgcgcaaactagaaacaaatgaaagtttatggataggtatttaaatgatgtttaaagagcaatttyttaaaagctttagcaagaatctgcttagaaggggggagtttggcaactggagaaaaagtttcctaccttctttatttgttgataatcatatacgatattcttggaaattcttaagagaaaggagatcgggtgtatttgtaatgtatcatatgctggactgtttggtcttgtcaaacaatatagttgtaatttgcttctcttttcttctttattttaaatatagaaaaatgttatt

SEQ ID NO: 248 - protein, 221 aa, Glycine max
  misc_feature: Ceres CLONE ID no.546675
  misc_feature: Bit score of 131.8 for HMM based on sequences of FIGURE 13.
  misc_feature (127)..(215): Pfam Name: Synaptobrevin Pfam Description: Synaptobrevin
  misc_feature: Functional Homolog Of Ceres CLONE ID no. 41543 at SEQ ID NO. 160
  misc_feature (164)..(164): Xaa is any aa, unknown, or other
MSQESFIYSFVARGTMVLAEYTEFTGNFPAIAAQCLQKLPSSNNKFTYNCDHHTFNFLVEDGYAYCVVAKESVSKQISIAFLERVKADFKKRYGGGKADTAVAKSLNKEFGPVMKEHMKYIIDHAEEIEKLIKVKAQVSEVKSIMLENIDKAIDRGENLTILAXKTETLHSQAQEFKKQGTHVRRKMWYQNTKIKLVVLGILLLLVLVIWLSVCHGFNCAN

SEQ ID NO: 249 - DNA, 1479 bp, Glycine max
  misc_feature: Ceres CLONE ID no.522046
  misc_feature: Encodes the peptide sequence at SEQ ID NO 250
ttttctctctctacaaagagtgcgtgtgagagtgagagagagagagagagggatttggaactttggatatctatagcgaaagcgtgacaccaccaaaaaccgaactgttcccagatctctctctcactcttccaacaatcgaaatccaaaaccctaccgacaccacactcaatcgaaattcttcattctcttctcatcgatggggcagaagtctctgatctacgcgttcgtgtcgcggggaacagtgattctcgcggagtacaccgaattcagcggaaacttcaactccatcgccttccagtgccttcagaagctccctgccaccaacaacaagttcacctacaattgcgacgcacacaccttcaattacctcgtcgacaatggctacacatattgtgttgttgcagatgaatcaactggaagacagttacccatggcttttctagagcgtgtcaaagatgaatttgtgtcaaaatatggtggtggaaaggctgccacagctcctgcaaacagccttaacaaggaatttgggccaaagttgagggaacatatgcagtactgtgttgatcatcctgaagagataagcaaacttgcaaaggtgaaagctcaggtttctgaagttaagggtgtcatgatggagaatattgaaaaggttctggacaggggtgacaagatagaacttctggtggacaagactgagaaccttcataaccaggttagtatgatgtactacgtgctatgaagtatgtgtgtgcatctaaatgtcgttcctttatagtgtagatttcatatctatgctatagaaaggagatttatttcttttggtggctgaatcatttttgaagtggatgctaagtgtagcatattgaaaggagattcctcacttttggtgtcttcattatctctctcagaccagctagttacatccatttctatttttaaagaattgtttctatatcttacagtttccaccctctgctctcctcacaatgccaaaacaaacaaaaaaagtctaagatcctgagacccacatgttttcacttttctgtttcaattttaactttgatatggatgtggtagtgcaaatttatatttcaccatttgtgaggaaagaaatattttcttccaggcacaagatttcaggacttctggaaccagaatccgtcgaaaaatgtggctgcaaaacatgaagataaagctgattgtattgggaatattgatagcacttatcctgataatagtcctatctgtgtgtcgtgggttcaactgtggaaaatagcaccattctccgaggccttttatcatgttatttcaaccttgagattatcggagaaaagatactaatgaatggcatgagtttgtatgtaatatagatatagatatagtaaaggtcgtatgttggtcactttgatctacttataaatgcttttgaaaatataatttgggttgtcaaattgaaatttgatttccattttattt

SEQ ID NO: 250 - protein, 180 aa, Glycine max
  misc_feature: Ceres CLONE ID no.522046
  misc_feature: Bit score of 75.0 for HMM based on sequences of FIGURE 13.
  misc_feature (127)..(172): Pfam Name: Synaptobrevin Pfam Description: Synaptobrevin
  misc_feature: Functional Homolog Of Ceres CLONE ID no. 41543 at SEQ ID NO. 160
MGQKSLIYAFVSRGTVILAEYTEFSGNFNSIAFQCLQKLPATNNKFTYNCDAHTFNYLVDNGYTYCVVADESTGRQLPMAFLERVKDEFVSKYGGGKAATAPANSLNKEFGPKLREHMQYCVDHPEEISKLAKVKAQVSEVKGVMMENIEKVLDRGDKIELLVDKTENLHNQVSMMYYVL

SEQ ID NO: 251 - DNA, 998 bp, Glycine max
  misc_feature: Ceres CLONE ID no.651076
  misc_feature: Encodes the peptide sequence at SEQ ID NO 252
attccagaatggaaggaaagagtcttatagtgcctcctcctctttgacttcatccctatcttccgaattttcctagttttgaaaaatcctacacacgcttttgcttccacctcctttcctcaccttaaattaaattattgttcaacaatcaatatcaatataattcaattccttcaaattccagataccaaaaacatatattctttctctttgttttcttgtctgtggtattgtctctgagttgttaattttgttttctttcctttctcatggggcagcaatcgttgatttacagcttcgtggcgcgcggcacgatgatcctggcggagcacactgatttcagtggaaactttgcggaggtggctttgcagtgcctgcagaggctcccagcctccgacaacaaattcacctacaacgccgatggccacaccttcaactacctcacctataatggattcacttactgtgttgtggcagtagagtctgttggtcgccaacttgcaatggcctatcttgaacgcatcatggaggatttttccaagagatatggtggaggaaaagctacaacagccactgctaaaagcttaaacaaagaatttggatccaagttgaaggaacatatgcagtattgtgtggaacacccagaagaggttagcaaacttgcaaaagtgaaagctcaggtttcagaagtccaacaagttatgagggcaaacattgatcaggttcttgatcgtcaagtgaagattgacgttttagtgggtcaaactgaggaccttcgcaatcaggcgggggttttcagggagcggggagaccagataaggagaaagatgtggtatcaaaacatgaagataaagttaatagtacttgccatcgtgattgccatcattttaataattgtcttattggtcacctagaattgttacaactcgaccccttttttgtaatttaataaatatagttgtataatataaacattataaatttgtttatttgattgc

SEQ ID NO: 252 - protein, 214 aa, Glycine max
  misc_feature: Ceres CLONE ID no.651076
  misc_feature: Bit score of 101.9 for HMM based on sequences of FIGURE 13.
  misc_feature (127)..(213): Pfam Name: Synaptobrevin Pfam Description: Synaptobrevin
  misc_feature: Functional Homolog Of Ceres CLONE ID no. 41543 at SEQ ID NO. 160
MGQQSLIYSFVARGTMILAEHTDFSGNFAEVALQCLQRLPASDNKFTYNADGHTFNYLTYNGFTYCVVAVESVGRQLAMAYLERIMEDFSKRYGGGKATTATAKSLNKEFGSKLKEHMQYCVEHPEEVSKLAKVKAQVSEVQQVMRANIDQVLDRQVKIDVLVGQTEDLRNQAGVFRERGDQIRRKMWYQNMKIKLIVLAIVIAIILIIVLLVT

SEQ ID NO: 253 - protein, 219 aa, Medicago truncatula
  misc_feature: Public GI ID no.92867368
  misc_feature: Bit score of 646.8 for HMM based on sequences of FIGURE 13.
  misc_feature (123)..(211): Pfam Name: Synaptobrevin Pfam Description: Synaptobrevin
  misc_feature: Functional Homolog Of Ceres CLONE ID no. 41543 at SEQ ID NO. 160
MGILYALVARGTVVLAEFTGTTTNAAAIARQILEKIPGNNDTHVSYSQDRYIFHVKRTDGLTVLCMADDSVGRRIPFAFLEEIHQRFVRSYGRAVLTAEAYAMNDEFSRVLNQQMEYFSSDPNADRINRLKGEMSQVRNVMIENIDKVLDRGDRLELLVDKAANMQGNTFRFRKQARRFRSTVWWRNVKLTIALIVILIVIAYVVLAFVCHGPALPSCF

SEQ ID NO: 254 - protein, 267 aa, Medicago truncatula
  misc_feature: Public GI ID no.92897590
  misc_feature: Bit score of 94.4 for HMM based on sequences of FIGURE 13.
  misc_feature (131)..(173): Pfam Name: Synaptobrevin Pfam Description: Synaptobrevin
  misc_feature: Functional Homolog Of Ceres CLONE ID no. 41543 at SEQ ID NO. 160
MANNQNQKQLIYAFVSRGTVILAEFTEFSGNFNSIAFQCLQKLPSTNNKFTYNCDNHTFNYLIDNGYTYCVVADETTGRQVPMAFLERVKDDFVSKYGGEKASTAPPNSLNKEFGPKLKEHMQYCVDHPDEISKLAKVKAQVSEVKGVMMENIEKVLDRGEKIELLVDKTDNLHHQGQRQGTRLQEFWNLNPSKNVAAKHEGKADCVGNFDSTDPHNSPFCDSGIISTILCGLYCYSNLVIIQGDVNVWHVFVCNIDFKSVEVVTLF

SEQ ID NO: 255 - DNA, 991 bp, Triticum aestivum
  misc_feature: Ceres CLONE ID no.859707
  misc_feature: Encodes the peptide sequence at SEQ ID NO 256
cctccctcccctttctcctccccctgcccccgaggaaagaaagaaagaagaacagagtccacacggcagaggccagcggcggagaagcgggatgccgatcctgtacgcggtggtggcgcggggcgcgacggtgctggcggagcacagcgcggcggcgaccaacgcgggcgccgtcgcgcgccaggtcctcgagcgcctccccggcggcggcgccgacagccacgtctcctacacccaggaccgctacgtcttccacgccaagcgcaccgacggcatcaccgccctctgcatggccgacgacgccgccggacggcgtatcccatttgctttcctcgaggatatccatggaaagtttgttaagacatatggccgtgctgcactgacagctcttgcttatgcaatgaacgacgaattctcaagggttctcagtcagcaaatggactactattcaaatgaccctagtgcagatcaaatcaacctaatgaggggcgaaatcagtcaggttaggagtgttatgattgataatattgataaagtccttgaaagaggtgaccgtttagacctattggtggacaagactacaactatgcaaggaaatacggttcgattcaaaagacaagctcgccgctacagaagcacaacttggtggagaaatgtcaaactcacggccgcgttgatactcctcctgcttgtaatagtatacatcgccctcttcttcgtgtgccacggcttcaccttgccgacttgcatcaggtgaggggggccaggggcatataaattcgcctcgtggtgtgcttgtgtccatggcttgcctgtctcccagcccaggagagcgaccgttgcagcaccagtgcaaccagtcgcattgcaaaattattttttgtgtgtagagaggaaggggagggacctgagcctgctatttattctgtaattgtgacgccttggattgtgaagactccttttggaacgtaatcgagtgccttgctcattc

SEQ ID NO: 256 - protein, 221 aa, Triticum aestivum
  misc_feature: Ceres CLONE ID no.859707
  misc_feature: Bit score of 636.2 for HMM based on sequences of FIGURE 13.
  misc_feature (124)..(212): Pfam Name: Synaptobrevin Pfam Description: Synaptobrevin
  misc_feature: Functional Homolog Of Ceres CLONE ID no. 41543 at SEQ ID NO. 160
MPILYAVVARGATVLAEHSAAATNAGAVARQVLERLPGGGADSHVSYTQDRYVFHAKRTDGITALCMADDAAGRRIPFAFLEDIHGKFVKTYGRAALTALAYAMNDEFSRVLSQQMDYYSNDPSADQINLMRGEISQVRSVMIDNIDKVLERGDRLDLLVDKTTTMQGNTVRFKRQARRYRSTTWWRNVKLTAALILLLLVIVYIALFFVCHGFTLPTCIR

SEQ ID NO: 257 - DNA, 1092 bp, Triticum aestivum
  misc_feature: Ceres CLONE ID no.634176
  misc_feature: Encodes the peptide sequence at SEQ ID NO 258
ctggacccaaggtcaggtcagatcagatcagctcaggccgcctccgcttcccgactccagttccaatttcgattcccaccacgcccgcccctcgggaccgaggaggaggaggaggatggcgatcgtgtacgcgctcgtggcgcggggcacggtcgtgctggccgagttcgccgccgtctcgggcaacgccggcgccgtcgcccgtcgcatcctcgagaagctcccctccgaggccgaggcgcgcctctgcttcgcgcaggaccgctacatcttccacgtcctccgctcccccgccgacggcctcaccttcctctgcatggccaacgacaccttcggacggagagttcccttcatttatctcgaggacatccagatgaggttcatgaagaactatggcagggtcgcccattccgcgctggcctatgccatgaacgacgagtttgccagggtgctccaccagcaaatggagttcttctccagtaaccccagcgccgacacgctcaaccgcctccggggcgaagtcagcgagatacacaccgtcatggttgacaacatagagaagattcttgacagaggcgaccgcatctcgcttcttgtagacaagacctccacaatgcaggatagtggctttcacttccgcaagcaatccaagaggcttcggagagctctctggatgaagaatgtcaagcttctagcggtgttgacagcggtcattgtgctgctactttacctgatcattgcggctttctgcggaggcctatcccttccatcgtgcagatcataaaacagtagctcgacaccatacatgatgttccaagttcggctcagcttccagagcgaaagccttatgttttggtcaacagattcaaagttgagttctcgggtagattgtttttgcttatacaagtcgatatgaaatgtttgtacaaaaaccgggtctgtgtgtacagtatgaaatgtcgtttgtgcttctttgggtatgttgtggcactagttaagagttgctcggtgcactggttaatcgaaattattactgatgtatagtacctccctttctggaaaagatgtgaacactgaaaaaaaaaaaaaaaa

SEQ ID NO: 258 - protein, 222 aa, Triticum aestivum
  misc_feature: Ceres CLONE ID no.634176
  misc_feature: Bit score of 567.8 for HMM based on sequences of FIGURE 13.
  misc_feature (125)..(213): Pfam Name: Synaptobrevin Pfam Description: Synaptobrevin
  misc_feature: Functional Homolog Of Ceres CLONE ID no. 41543 at SEQ ID NO. 160
MAIVYALVARGTVVLAEFAAVSGNAGAVARRILEKLPSEAEARLCFAQDRYIFHVLRSPADGLTFLCMANDTFGRRVPFIYLEDIQMRFMKNYGRVAHSALAYAMNDEFARVLHQQMEFFSSNPSADTLNRLRGEVSEIHTVMVDNIEKILDRGDRISLLVDKTSTMQDSGFHFRKQSKRLRRALWMKNVKLLAVLTAVIVLLLYLIIAAFCGGLSLPSCRS

SEQ ID NO: 259 - DNA, 1109 bp, Triticum aestivum
  misc_feature: Ceres CLONE ID no.1041432
  misc_feature: Encodes the peptide sequence at SEQ ID NO 260
cttcctggacccaaggccagatcagatcagctcaggccgcctccgcttcccgaccccagttccaatttcgattcccacccccacccccgcccctcgggaccgaggaggaggaggaggaggaggaggatggcgatcgtgtacgcgctcgtggcgcggggcacggtcgtgctggccgagttcgccgccgtctcgggcaacgccggcgccgtcgcccgccgcatcctcgagaagctcccctccgaggccgaggcgcgcctctgcttcgcgcaggaccgctacatcttccacgtcctccgctcccccgccgacggcctcaccttcctctgcatggccaacgacaccttcggacggagagttcccttcatttatctcgaggacatccagatgaggttcatgaagaactatggcagggtcgcccattctgcgctggcctatgccatgaacgacgagttcgccagggtgttgcaccagcaaatggagttcttctccagtaaccccagtgccgacacgctcaaccgcctccggggtgaagtcagtgagatacacaccgtcatggttgacaacatagagaagattctggacagaggcgaccgcatctcgcttcttgtagacaagacctccacaatgcaggacagcggttttcacttccgcaagcaatccaagaggcttcggagagctctctggatgaagaatgtcaagcttctagcggtgttgacgggggtcattgtgctgctactttacctgatcattgctgctttctgcggaggcctatcccttccatcgtgcagatcatagaacactagctctacacctccatacatgatgttccaagttcggctcagcttccagagctaaaaccttatgttttggtcaacagattcgcagttgagttctcggtagattgtttttgctcatacaagtcgatatgaaatgtttgtacaaaaaccgggtccgtgtgtacagtatgaaatgtcgtttgtgcttcctttgggtatgttgtggcactagttaagagttgctcggtgcactggttcgtcgaaatttttactgatgtatagtacctccctttctggaaaagatgtgaacactgaacaaaaaaaaaaaaaaaa

SEQ ID NO: 260 - protein, 222 aa, Triticum aestivum
  misc_feature: Ceres CLONE ID no.1041432
  misc_feature: Bit score of 566.5 for HMM based on sequences of FIGURE 13.
  misc_feature (125)..(213): Pfam Name: Synaptobrevin Pfam Description: Synaptobrevin
  misc_feature: Functional Homolog Of Ceres CLONE ID no. 41543 at SEQ ID NO. 160
MAIVYALVARGTVVLAEFAAVSGNAGAVARRILEKLPSEAEARLCFAQDRYIFHVLRSPADGLTFLCMANDTFGRRVPFIYLEDIQMRFMKNYGRVAHSALAYAMNDEFARVLHQQMEFFSSNPSADTLNRLRGEVSEIHTVMVDNIEKILDRGDRISLLVDKTSTMQDSGFHFRKQSKRLRRALWMKNVKLLAVLTGVIVLLLYLIIAAFCGGLSLPSCRS

SEQ ID NO: 261 - DNA, 882 bp, Triticum aestivum
  misc_feature: Ceres CLONE ID no.1065203
  misc_feature: Encodes the peptide sequence at SEQ ID NO 262
atagatctctacttagcttctccgcgatacaagcccatttaaattcacatccaaccggatcgaggatttagggttcgcgaaaaaaatggcgcaacaacaatcgttgatctacagcttcgtcgctcgcgggacggtgatcctcgccgagttcactgatttcaaaggcaacttcacctccgtcgctgcacagtgcctccagaagctcccctcttccaacaacaagttcacctacacctgcgacggccacaccttcagttacctcgtcgaagatggattcacgtactgtgttgttgcggttgattctgctgggaggcagattccgatggcgtttttggagagagtgaaagaggattttagcaagagatatggtggtgggaaggctgctactgctcaggctaacagcttcaataaagagtttggctctaagctgaaagagcacatgcagtattgtatggatcaccctgatgagattagcaagcttgctaaggtgaaggctcaagtctctgaagttaaaggtgttatgatggaaaacatcgagaaggttcttgaccgtggtgagaaaattgagcttctggtggacaaaaccgagaaccttcgctctcaggcacaagacttcagaacaacggggacacagatgagaagaaagatgtggcttcagaacatgaagattaaactcatagttctcgccatcatcgtcgcactgattctcatcatcgtgctctcagtttgccatggcttcaagtgttaaagagccccatcaaagttaaaaaaactctcttgaaatctttttctcactcggtcttcgtaatctatatataatagcaaaccatttttattaatctgatgatgtcatcattttttataagaaaaaaaaaaaaaaaa

SEQ ID NO: 262 - protein, 220 aa, Triticum aestivum
  misc_feature: Ceres CLONE ID no.1065203
  misc_feature: Bit score of 179.6 for HMM based on sequences of FIGURE 13.
  misc_feature (128)..(216): Pfam Name: Synaptobrevin Pfam Description: Synaptobrevin
  misc_feature: Functional Homolog Of Ceres CLONE ID no. 41543 at SEQ ID NO. 160
MAQQQSLIYSFVARGTVILAEFTDFKGNFTSVAAQCLQKLPSSNNKFTYTCDGHTFSYLVEDGFTYCVVAVDSAGRQIPMAFLERVKEDFSKRYGGGKAATAQANSFNKEFGSKLKEHMQYCMDHPDEISKLAKVKAQVSEVKGVMMENIEKVLDRGEKIELLVDKTENLRSQAQDFRTTGTQMRRKMWLQNMKIKLIVLAIIVALILIIVLSVCHGFKC

SEQ ID NO: 263 - DNA, 1122 bp, Triticum aestivum
  misc_feature: Ceres CLONE ID no.555361
  misc_feature: Encodes the peptide sequence at SEQ ID NO 264
  misc_feature (785)..(785): n is a, c, t, g, unknown, or other
ctcccactccaccaaagcgaaaccgacctttcccccttcccctcccctcccctcccctcccgcagcagcctcgccgagatccaatccggcagcccccctcccccgccggcggcgagctccagcggagaggcggcgaagcgcgcgggaggagccatgggccagcagtcgctcatctacgcgttcgtggcccgcggcacggtggtgctggccgagtacaccgagttcaccggcaacttcaccaccatcgcctcccagtgcctcgtcaagctccccgccagcaacaacaagttcacctacaactgcgacggccacaccttcaactacctcgtcgaggacggcttcacatactgtgtggttgctgtggaatcagtggggcaacagatgccaattgctttcttggttcgggttaaggacgatttcagcaaaagatatgctggtgggaaagctgctactgctgcaccaagcagcctcaacagagagtttgggtcaaaactcaaagagcacatgcagtactgtgtagaccaccctgaagagataaacaagctcgctaaagtgcaagcacaagtttcagaagtcaagaacgtgatgatggaaaacattgagaaggttcttgatcgcggggagaagattgagctgcttgttgacaagacagagaatctccgctcacaggcccaagatttcaggcagcaaggaacacaggtgaggagaaagatgtggctacaaaacatgaagatcaagctgattgtcctgggcatcatcgtcgcgctcatcctcatcataatccngtcggtgtgccatgggttcaactgtggcaagtccaagtgaggactactcgaggtcgtgagacacattcaactgtccttatattactgctgattcgagcaaaacccatatatggtgcttagtgttctttcttctctagtgtgcgctggcccgggccgcggtgcctgtgggtgggtctgtgttttcgttgtcgtcgtgttgggatgttcgcttaccgccggatgggtggtggctgggtcggcgggtcgtgtatttttggacgctatgtatgtatagcttggatcttgacatctttgttctattgttatatgatgatgaggatgagtagtagatttactc

SEQ ID NO: 264 - protein, 223 aa, Triticum aestivum
  misc_feature: Ceres CLONE ID no.555361
  misc_feature: Bit score of 170.2 for HMM based on sequences of FIGURE 13.
  misc_feature (127)..(215): Pfam Name: Synaptobrevin Pfam Description: Synaptobrevin
  misc_feature: Functional Homolog Of Ceres CLONE ID no. 41543 at SEQ ID NO. 160
  misc_feature (211)..(211): Xaa is any aa, unknown, or other
MGQQSLIYAFVARGTVVLAEYTEFTGNFTTIASQCLVKLPASNNKFTYNCDGHTFNYLVEDGFTYCVVAVESVGQQMPIAFLVRVKDDFSKRYAGGKAATAAPSSLNREFGSKLKEHMQYCVDHPEEINKLAKVQAQVSEVKNVMMENIEKVLDRGEKIELLVDKTENLRSQAQDFRQQGTQVRRKMWLQNMKIKLIVLGIIVALILIIIXSVCHGFNCGKSK

SEQ ID NO: 265 - DNA, 1238 bp, Triticum aestivum
  misc_feature: Ceres CLONE ID no.704227
  misc_feature: Encodes the peptide sequence at SEQ ID NO 266
aaaaaaactaaggcaacgcaacaagacggaatagacccgcaaccgctgcgccctcttccggtcgattcacgttcactgcgagggggaggaggaggaggacggccagcccctgcgcgagacgagcctctacaagggcttctgcggtggctaatttcgggaggtagaagagggaggaggagccatgaacggtggtagcaagcaaacactgatatacagcttcgtggccaagggctccgtggtgctggccgagcacacggccttctctggcaacttcagcaccatcgccgtgcagtgcctccagaagctgccctccaacagcacaaggtccacctactcctgcgatggccacaccttcaacttcctcgtcgaccgtgattttgtgtttcttgtggtggccgaagaggcgctgggaaggagcgtgccgtttgtgttcctagagagggttagggaagacttcatgcagcggtatgggtccagtatcgatgaggagggacaacacccgcttgctgatgacgcggatgaggacgatttcctgtttgaggaccggtttagcatcgcctacaatcttgaccgggaattcgggccaaggttgaaggatcacatgcagtattgtattaatcatccagaggaaattagcaagctctctaaggtgaaatcacatctttcagaggttaaagggatcatgatggacaacatcgagaagatattagatcgtggcgagaagattgaacttttggtgggaaagaccgaaaccttacagtcgcaggccgacagcttccataggcatggcagagagctcaggcgcaagatgtggcttcagaacctgaggtttaagctgatggtcggtggtggcatcgcgtttttgatcctcatcctctggctaatggtttgctggggcttcaagtgctagagagttcagagtcttcattcgccctttttttccttgtcatttgatgttctgtttacggtgtcatgtgcatataatgaccaccaaattatgcttcgctatgttccgaacaaaagttatgtggtgtgagacccttaattcctcatagaccatccttatgttccataagaccatagggatctggagtactcgtgtaagctttatgagagagggggacgtcagtcgattatctgtacattctgaactgcaagcttattgcctggaccttgttttgctcagatcctcttgacgatgatccatgttgcacctagcgccaaaaaaaaaaaaaaaa

SEQ ID NO: 266 - protein, 242 aa, Triticum aestivum
  misc_feature: Ceres CLONE ID no.704227
  misc_feature: Bit score of 128.2 for HMM based on sequences of FIGURE 13.
  misc_feature (150)..(238): Pfam Name: Synaptobrevin Pfam Description: Synaptobrevin
  misc_feature: Functional Homolog Of Ceres CLONE ID no. 41543 at SEQ ID NO. 160
MNGGSKQTLIYSFVAKGSVVLAEHTAFSGNFSTIAVQCLQKLPSNSTRSTYSCDGHTFNFLVDRDFVFLVVAEEALGRSVPFVFLERVREDFMQRYGSSIDEEGQHPLADDADEDDFLFEDRFSIAYNLDREFGPRLKDHMQYCINHPEEISKLSKVKSHLSEVKGIMMDNIEKILDRGEKIELLVGKTETLQSQADSFHRHGRELRRKMWLQNLRFKLMVGGGIAFLILILWLMVCWGFKC

SEQ ID NO: 267 - DNA, 1148 bp, Zea mays
  misc_feature: Ceres CLONE ID no.392275
  misc_feature: Encodes the peptide sequence at SEQ ID NO 268
acacaataggctggcagagaggcaggcaaccagctcgggcgtgtccttcctcctccgtctccatcttggcccaaccgagcccaaacctctccccttttctccgtcctctcctagtccacacggcagacgccgccgccgggggagaggagaggaggggaggggatcggctccaagggaacaggtgagatggcaatcctgtacgcgctggtggcgcgcggcacggtggtgctggcggagcacagcgcggcagccaccaacgcgggcgctatcgcgcgccaggtcctcgagcgcctccccgacggcggcgccgacagccacgtctcctacacgcaggaccgctacgtcttccacgccaagcgcaccgacggcatcaccgcgctctgcatggccgacgacgccgccggaagacggattccctttgcatttttggaggatattcatggaaggtttgtcaagacatatggccgggctgcactaaccgctcttgcatatgcaatgaatgatgaattctcaagggtcttgagccagcaaatggactactattcaaatgaccctagtgcagatagaataaaccgcatgagaggtgaaatcaatcaggtccgtagtgttatgattgataacattgataaggttcttgaaagaggtgatcgtttggaactgctggttgacaagactgcaaatatgcaaggaaatacagttcgattcaagagacaagctcggcggttcagaaacactgtttggtggagaaatgtcaaactcacggccgcattgatacttctcctcctggtaataatatatgtcgttctagtcttcgtgtgccatggtttcaccctaccaacttgcataaggtaaggcatgatgtgcacaaagtgctttttgctgtgcatgtttgtgcctgtcaccggggggcagcagccgttgcaattgtttcttgtgtagaggaaagctacatattatgatgtgattgtgagaactcaattaaagatgtgaacttaacataaaaagtgcttcttgtgggtttggctatgaccttgtagctctatgagaattgggtgtttggattggtgtttatttgtggctattcttgtgtctgtacatgaattcagttacgacgagtattttatggctatgctaatgtaatattcttg

SEQ ID NO: 268 - protein, 221 aa, Zea mays
  misc_feature: Ceres CLONE ID no.392275
  misc_feature: Bit score of 654.1 for HMM based on sequences of FIGURE 13.
  misc_feature (124)..(212): Pfam Name: Synaptobrevin Pfam Description: Synaptobrevin
  misc_feature: Functional Homolog Of Ceres CLONE ID no. 41543 at SEQ ID NO. 160
MAILYALVARGTVVLAEHSAAATNAGAIARQVLERLPDGGADSHVSYTQDRYVFHAKRTDGITALCMADDAAGRRIPFAFLEDIHGRFVKTYGRAALTALAYAMNDEFSRVLSQQMDYYSNDPSADRINRMRGEINQVRSVMIDNIDKVLERGDRLELLVDKTANMQGNTVRFKRQARRFRNTVWWRNVKLTAALILLLLVIIYVVLVFVCHGFTLPTCIR

SEQ ID NO: 269 - protein, 221 aa, Zea mays
  misc_feature: Ceres CLONE ID no.100819945
  misc_feature: Bit score of 616.3 for HMM based on sequences of FIGURE 13.
  misc_feature (124)..(212): Pfam Name: Synaptobrevin Pfam Description: Synaptobrevin
  misc_feature: Functional Homolog Of Ceres CLONE ID no. 41543 at SEQ ID NO. 160
  misc_feature (131)..(131): Xaa is any aa, unknown, or other
  misc_feature (133)..(133): Xaa is any aa, unknown, or other
  misc_feature (183)..(183): Xaa is any aa, unknown, or other
  misc_feature (187)..(187): Xaa is any aa, unknown, or other
  misc_feature (192)..(192): Xaa is any aa, unknown, or other
  misc_feature (194)..(194): Xaa is any aa, unknown, or other
  misc_feature (204)..(204): Xaa is any aa, unknown, or other
  misc_feature (207)..(207): Xaa is any aa, unknown, or other
  misc_feature (208)..(208): Xaa is any aa, unknown, or other
  misc_feature (215)..(215): Xaa is any aa, unknown, or other
MAILYALVARGTVVLAEHSAAATNAGAIARQVLERLPDGGADSHVSYTQDRYVFHAKRTDGITALCMADDAAGRRIPFAFLEDIHGRFVKTYGRAALTALAYAMNDEFSRVLSQQMDYYSNDPSADRINRXRXEINQVRSVMIDNIDKVLERGDRLELLVDKTANMQGNTVRFKRQARRFRNXVWWXNVKLXAXLILLLLVIIXVVXXFVCHGFXLPTCIR

SEQ ID NO: 270 - DNA, 1162 bp, Zea mays
  misc_feature: Ceres CLONE ID no.282584
  misc_feature: Encodes the peptide sequence at SEQ ID NO 271
agtgtggaggggaggcagggtagcccccgcggcgccgctccgctcgaaatccccaaaaaggcaagatcaaatcaaatcagatctctccacccccagcccatccatggcgatcgtgtacgccctggtcgcgcggggcacggtggtgctggccgagttcgccgccgtctcgggcaacgccggcgccgtggcccgtcggatcctcgagaagctgccgcccgacgccgagtccaggctgtgcttcgcgcaggaccggtacatcttccacgtcctccgatccgacgccgccggcatcaccttcctctgtatggccaacgacaccttcggaacaaggatcccctttctctacctggaggacatccaaatgaggttcatgaaaaactacggcagagtcgcccactctgcgctggcttacgccatgaacgatgagttctccagagtgctccatcagcaaatggagttcttctccagcaacccaagcgccgacacactcaaccgtctccgtggagaagtcagcgagatacacaccgtcatggtcgacaacatagagaaaattcttgacagaggcgatcgcatctcgctccttgtcgacaagacatccaccatgcaagacagcgcctttcacttccgcaagcaatccaagaggctccgtagagctctttggatgaagaatgccaagcttctagttgtgttgacagttgtcatagtagtgctgctctacttgatcatttctgctttctgtggaggcctttccttgtcatcatgcagatcatgagtaacacaccagatggctttgcccctcccttaaatggagggtagaacaccatggaatgatgcctgctgtgttgagcaccggagcttccggaggcaaaaaaaaaaaggagatcgatggataccactgtggtttccagtaactgggatcagattgtacagtggacgagtggagttggccgttgctgtttttgatgtcgccatggttgtgggtgaactcaattcttaaatcgtggtgtgcttagcatctttcttgccttgtcaaactgtcgttgtgacttgtgagggatgggactagtgagttgggttttgtagagttacatggttatcaatgtgcagacatatatgtatgccgcgatgagtgttagtacatgcctactatggttatcggtgt

SEQ ID NO: 271 - protein, 222 aa, Zea mays
  misc_feature: Ceres CLONE ID no.282584
  misc_feature: Bit score of 578.8 for HMM based on sequences of FIGURE 13.
  misc_feature (125)..(213): Pfam Name: Synaptobrevin Pfam Description: Synaptobrevin
  misc_feature: Functional Homolog Of Ceres CLONE ID no. 41543 at SEQ ID NO. 160
MAIVYALVARGTVVLAEFAAVSGNAGAVARRILEKLPPDAESRLCFAQDRYIFHVLRSDAAGITFLCMANDTFGTRIPFLYLEDIQMRFMKNYGRVAHSALAYAMNDEFSRVLHQQMEFFSSNPSADTLNRLRGEVSEIHTVMVDNIEKILDRGDRISLLVDKTSTMQDSAFHFRKQSKRLRRALWMKNAKLLVVLTVVIVVLLYLIISAFCGGLSLSSCRS

SEQ ID NO: 272 - DNA, 987 bp, Zea mays
  misc_feature: Ceres CLONE ID no.1448469
  misc_feature: Encodes the peptide sequence at SEQ ID NO 273
agttaagtcttcttctctagatctctgccttcctccgatccatcgctctccgcgtcgtttttcatagaagaaaatggcgcagcaatcgtcgttgatctacagcttcgtcgctaggggcacagtaatcctcgtggagttcaccgatttcaaaggtaactttacgtccgtcgctgcacagtgcctccagaagcttccgtcctcgaacaacaagttcacctacaactgcgatggccacaccttcaattacctcgtcgaaaacggattcacttattgtgttgttgcagttgattctgctgggaggcagattctcatggcttttttggaacgggtgaaggaggatttcaataagagatatggtggtggaaaggctgctactgctcaggctaacagcttgaataaagagtttgggtcgaaactgaaagagcacatgcagtattgcatggatcatcctgatgagattagcaagcttgctaaggtgaaagctcaggtgtctgaagttaaaggtgtcatgatggaaaacattgaaaaggttcttgaccgtggtgagaaaattgaacttttggtggacaaaactgaaaaccttcgctcacaggcgcaagatttcaggacacaaggaacacagatgagaagaaagatgtggtttcagaacatgaagataaagctcattgttctagcaatcatcattgccttgatcctcatcatcgtcctctcagtctgcggtggcttcaactgtggcaaataagtctgggaacatttcttcctcctagtgattttccgtcaacatcctcagtcacttcgttgtgctgctttcgctcttttttgtggtttctaaattctctcatgctatctttatctgcttagattgtacgtctttgaaattggttttgtataggccatatatatgtatgaatgttcgacattttgccaacatttgctattattggtggtatcaacacggattcttgcgaaccaaaaaaaaaaaaaaaa

SEQ ID NO: 273 - protein, 222 aa, Zea mays
  misc_feature: Ceres CLONE ID no.1448469
  misc_feature: Bit score of 167.0 for HMM based on sequences of FIGURE 13.
  misc_feature (128)..(216): Pfam Name: Synaptobrevin Pfam Description: Synaptobrevin
  misc_feature: Functional Homolog Of Ceres CLONE ID no. 41543 at SEQ ID NO. 160
MAQQSSLIYSFVARGTVILVEFTDFKGNFTSVAAQCLQKLPSSNNKFTYNCDGHTFNYLVENGFTYCVVAVDSAGRQILMAFLERVKEDFNKRYGGGKAATAQANSLNKEFGSKLKEHMQYCMDHPDEISKLAKVKAQVSEVKGVMMENIEKVLDRGEKIELLVDKTENLRSQAQDFRTQGTQMRRKMWFQNMKIKLIVLAIIIALILIIVLSVCGGFNCGK

SEQ ID NO: 274 - DNA, 1201 bp, Zea mays
  misc_feature: Ceres CLONE ID no.241246
  misc_feature: Encodes the peptide sequence at SEQ ID NO 275
agaattccatttatttcatcctctctttttttttttccattccacgcccctcccaacactcccagacccatttccctttccttcccctccggctccgcctcctcgaccactccgacaacccccagcgcctcctctccggcgagctccacctctccaccggcggcggcgagaagcgggggggctaactaagtctgtaggctgcggcggaggtgatcccggagccggagccgagtctagggcgatggggcagcagtcgctgatctacgcgttcgtggcgcgtggcaccgtggtgctggccgagtacaccgagttcaccggcaacttcaccaccatcgccgcccagtgcctgcagaagctccccgccagcaacaacaagttcacctacaactgcgacggccacaccttcaactacctcgtcgaggacggattcacgtattgtgtagttgctgttgaatcagttgggcgacaaatccccatagctttcctggacagagttaaggaagacttcaccaaaaagtatggaggcgggaaagcagctactgctgcagcgaacagcttgaacagggagtttggatcaaagcttaaagagcacatgcagtactgtgtggaccaccctgaggaggttagcaagcttgccaaggtgaaggcccaagtctccgaagtcaaaggagttatgatggaaaacattgagaaggttcttgaccgtggcgagaagattgaactgcttgtcgacaaaactgaaaatctgcgttctcaggcacaagatttcaggcagcaggggcaccaaggtgcggcggaagatgtggctccaaaacatgaagatcaagctgatcgtgctgggcatcatcatcgcgctcatcctcatcatcatcctgtcggtgtgccatggcttcaagcgcggcagcaagtgaggagggggacttacggatggccgtgccctgccctgccctgccctggcacctgcgagaaggaggagactacatgtggagtttttttttgcttctttagtcgtcgtgttaagtcgtcctgcgccgataattcttggtggtcaccagataaagagtcattcctggtgtcggtgttgattgctgttggttggtcgggaaatgactgggtgaaccgaggggcgaagtgggaggggggttgtgtcgtgtaattttggatgccactattgtgcatgtatagccccgtgtgctgtgct

SEQ ID NO: 275 - protein, 304 aa, Zea mays
  misc_feature: Ceres CLONE ID no.241246
  misc_feature: Bit score of 99.3 for HMM based on sequences of FIGURE 13.
  misc_feature (127)..(182): Pfam Name: Synaptobrevin Pfam Description: Synaptobrevin
  misc_feature: Functional Homolog Of Ceres CLONE ID no. 41543 at SEQ ID NO. 160
MGQQSLIYAFVARGTVVLAEYTEFTGNFTTIAAQCLQKLPASNNKFTYNCDGHTFNYLVEDGFTYCVVAVESVGRQIPIAFLDRVKEDFTKKYGGGKAATAAANSLNREFGSKLKEHMQYCVDHPEEVSKLAKVKAQVSEVKGVMMENIEKVLDRGEKIELLVDKTENLRSQAQDFRQQGHQGAAEDVAPKHEDQADRAGHHHRAHPHHHPVGVPWLQARQQVRRGTYGWPCPALPCPGTCEKEETTCGVFFCFFSRRVKSSCADNSWWSPDKESFLVSVLIAVGWSGNDWVNRGAKWEGGCVV

SEQ ID NO: 276 - DNA, 1136 bp, Zea mays
  misc_feature: Ceres CLONE ID no.234443
  misc_feature: Encodes the peptide sequence at SEQ ID NO 277
aaaactccaaagacacgattgtagttggattaatttcccaccccacaaccccccaccacaagaacttgttcgatcgaattcttcttcaactacccgccgcgggaacccaaggaaggaggcaaagcaaaggcttctcgcagggtttcccgtcagcggcttctgcggcgggcgccatgaacagcagcaagcaggcgctgatttacagcttcgtggccaagggctccgtcgtgctggcggagcacacggccttctccggcaacttcagcaccgttgccgtccagtgcctccagaagcttccccccaacagcaccagatccacctactcctgtgacggccacaccttcaacttcctcgtcaaccgcggcttcgtgttcctagtggtcgccgatgaggcggccgggaggagcgtccccttcgtcttcctagagagggttagggaagacttcatgcagcggtatgggtccagtatcgatgaggaggggcagcacccgctcgctgatgatgctgatgaggatgactttctgttcgaagaccggttcagcattgcctacaaccttgaccgtgaattcggcccgaggttgaaggaccatatgcagtattgtgttaatcatccagaggaaattaacaagctctccaaggtgaaagcccacctatcggatgtcaaagggatcatgatggacaacattgagaagatattggatcgcggggagaagattgagcttttggtgggtaagacagagaccctacagtcacaggcggacagcttccacaggcatggcagagagttgaggcgaaagatgtggcttcagaacctgaggtttaagctgatggtgggtggcggcattgcggctctgatccttatcatttggctgatggtctgcaggggattcaaatgttagagcacaccaagttgctcgccttttttttttcttttcaggcgtttgatatgcacagactttcaaccaaattgtgttttcagtgtcacggtatcgcaatgtagtggacttcaatccccgcagtctttcccatgttccattacttccatatgataatggtaaaaggtaggaagctggagtacgcggtcagaactgtctggaggagatatgacatcacgacttaaatatctgtacattcct

SEQ ID NO: 277 - protein, 241 aa, Zea mays
  misc_feature: Ceres CLONE ID no.234443
  misc_feature: Bit score of 144.5 for HMM based on sequences of FIGURE 13.
  misc_feature (149)..(237): Pfam Name: Synaptobrevin Pfam Description: Synaptobrevin
  misc_feature: Functional Homolog Of Ceres CLONE ID no. 41543 at SEQ ID NO. 160
MNSSKQALIYSFVAKGSVVLAEHTAFSGNFSTVAVQCLQKLPPNSTRSTYSCDGHTFNFLVNRGFVFLVVADEAAGRSVPFVFLERVREDFMQRYGSSIDEEGQHPLADDADEDDFLFEDRFSIAYNLDREFGPRLKDHMQYCVNHPEEINKLSKVKAHLSDVKGIMMDNIEKILDRGEKIELLVGKTETLQSQADSFHRHGRELRRKMWLQNLRFKLMVGGGIAALILIIWLMVCRGFKC

SEQ ID NO: 278 - DNA, 1022 bp, Zea mays
  misc_feature: Ceres CLONE ID no.293549
  misc_feature: Encodes the peptide sequence at SEQ ID NO 279
gaacaacacgcattcctacaatcggacaatcctactccaagcattgagggacacggaggcggcgccgttcggcactgcacgctcacgggctcgcgcattagtggatactctcccccggcgccacgaaatcgtccgctctcaccaccttccatcggtccctcacgatcttgccaagaatccaagatccgcctgcggtagctagcggtcctatcttgatccgatggtgtcaccgactccgggagggaaggatgcaagggagggtggcggcaaggcggagtggatgatctacgccttcgtggcgcgcggcaccgcggtgctggcggagtacacggagttccccggcaacttccccgccatcgccgcgcaatgcctgcagcggctacccgccgggtcgtcctccgccggcaccggccctgacggccgtggcgatgcgccggcacggttcagctacgcctgtgaccgacacacattcaacttcctcttgtaccgcggctacgcctattgtgtagttgcggaggaatccgttccaaagaatgtctcagtggcatttcttgaaaggttaaaagatgacttcatgaagagatatggtggtggtaaagctgacacagctcttgcaaaatgtctaaataaagaatatggacaagttataaagcagcacattcaatatgttcttgatcattcagaggaactagataaaatgttaaaagtgcaagcccaagtttcagaagtgaaaaatataatgttagacagcatagaaaagacactgggccgtggagagaaattgagtgaactccaagacaagacttctgagctacatattcaggcccagcagttcaagaaacagggagtgaagattcgcaggaagacatggctacagaacatgaaaattaagttggtgattcttggaatccttttgctccttgtaatcatagtatgggtatctatttgtcagggctttgactgcaccaagcatgaaacataatagaaatggtacaacgctgcacaaaaaaaaaaaaaaaaaa

SEQ ID NO: 279 - protein, 253 aa, Zea mays
  misc_feature: Ceres CLONE ID no.293549
  misc_feature: Bit score of 127.3 for HMM based on sequences of FIGURE 13.
  misc_feature (156)..(244): Pfam Name: Synaptobrevin Pfam Description: Synaptobrevin
  misc_feature: Functional Homolog Of Ceres CLONE ID no. 41543 at SEQ ID NO. 160
MVSPTPGGKDAREGGGKAEWMIYAFVARGTAVLAEYTEFPGNFPAIAAQCLQRLPAGSSSAGTGPDGRGDAPARFSYACDRHTFNFLLYRGYAYCVVAEESVPKNVSVAFLERLKDDFMKRYGGGKADTALAKCLNKEYGQVIKQHIQYVLDHSEELDKMLKVQAQVSEVKNIMLDSIEKTLGRGEKLSELQDKTSELHIQAQQFKKQGVKIRRKTWLQNMKIKLVILGILLLLVIIVWVSICQGFDCTKHET

SEQ ID NO: 280 - protein, 231 aa, Aegilops tauschii
  misc_feature: Public GI ID no.109450926
  misc_feature: Bit score of 147.5 for HMM based on sequences of FIGURE 13.
  misc_feature (138)..(226): Pfam Name: Synaptobrevin Pfam Description: Synaptobrevin
  misc_feature: Functional Homolog Of Ceres CLONE ID no. 41543 at SEQ ID NO. 160
MARKGEGAGPNPPATTMIYAMVARGTLVVAEHTAYTGNFRDIAAQCLHKLPAGDSRFTYTCDGHTFTFLLHQGYAYCVVATESAGREVPLAFLERIKEEFNKRYAGGKAATATANSLTKDFGPRLKEQMQYCMDHPEEVSRLSKVQAQVSEVKGIMMENIDKVIDRGEQIDGLVTRTEQLHDHAMDFRTEGTRLRRRMWYQNMKIKLIVAGIVVAIILIIVLSICHRDHCK

SEQ ID NO: 281 - DNA, 1249 bp, Panicum virgatum
  misc_feature: Ceres CLONE ID no.1828394
  misc_feature: Encodes the peptide sequence at SEQ ID NO 282
gtgtccacgccgctgcgctgcgccccaaatccgaatcccccaaccccaaaccaaacccccaattcctcagggaggcgaattcgagtgaggtcagatcagaccccgcagccatcaggggatccaaatccaaatccatctgatcagatctctccgacccccatccccatggcgatcgtgtacgcgctggtggcgcgcggcaccgtcgtgctggccgagttcgccgccgtctcgggcaacgccggcgccgtcgcccgccgcatcctcgagaagctgccgcccgacgccgactcccgcctctgcttcgcgcaggaccgctacatcttccacgtcctccgcgccgacgccggcatcaccttcctctgcatggccaacgacaccttcggaaggaggatcccctttctctacctggaggatatccagatgaggttcatgaagaactacggcagagtcgcgcactccgcgctcgcctatgccatgaacgatgagttctccagggtcctccaccaccaaatggagttcttctccagcaaccccagcgccgacacgctcaaccgtctccgtggagaagtcagcgagatacacaccgttatggtcgacaacatagagaaaattctagacagaggtgaccgcatctcactccttgtcgacaagacatccaccatgcaagacagcgctttccacttccgcaagcaatccaagaggctccgcagagcgctttggatgaagaatgccaagcttctagctgtgttgacggttgccatagtagtgctactctacttgctcatttctgctttctgtggaggcctttccctaccatcatgcagatcatgaataatggctgtccctcgttcggagcatacacggttccccaccgtattgagcgcctgagctcgcagagccagaacggatgctttgagaagtaggcttgcaatgtggtttccagttagagggagtttgttttttgccggcatgagctttctgaagtgattcctgcaaaaacgggttcagaatgtacagtagtgaacagttgtttcaaggagcggagttgccctttgctgtacttatctctttcctgatgtggcctttcgtggatgagtctaatgtcttggattgtgcttgtgtggatgggtttggggtctagtgctgcctgctatctatatatattacatgtgtactctgcagtgaatgttaattgtatacttttgttagcagtctatcagaattaatacaaaaaaaaaaaaaaaaaaaa

SEQ ID NO: 282 - protein, 221 aa, Panicum virgatum
  misc_feature: Ceres CLONE ID no.1828394
  misc_feature: Bit score of 602.2 for HMM based on sequences of FIGURE 13.
  misc_feature (124)..(212): Pfam Name: Synaptobrevin Pfam Description: Synaptobrevin
  misc_feature: Functional Homolog Of Ceres CLONE ID no. 41543 at SEQ ID NO. 160
MAIVYALVARGTVVLAEFAAVSGNAGAVARRILEKLPPDADSRLCFAQDRYIFHVLRADAGITFLCMANDTFGRRIPFLYLEDIQMRFMKNYGRVAHSALAYAMNDEFSRVLHHQMEFFSSNPSADTLNRLRGEVSEIHTVMVDNIEKILDRGDRISLLVDKTSTMQDSAFHFRKQSKRLRRALWMKNAKLLAVLTVAIVVLLYLLISAFCGGLSLPSCRS

SEQ ID NO: 283 - DNA, 1055 bp, Panicum virgatum
  misc_feature: Ceres CLONE ID no.1803923
  misc_feature: Encodes the peptide sequence at SEQ ID NO 284
aaagaccaccgattccttggccacaaagctgaagacatttccgagcacaagagatagaggctccatcctcttcgtccatcggaatcggagaagaagaagatagccacagcctacagctacatagaatagaaacaaggaaggaataagcaaggatccatggcgcagccgccggagggagcgctgatctacgcgatggtggcgcggggcacggtggtggtggcggagcacacgtcctacgcgagcaacttccgggacatcgccgcgcagtgcctgcaccggctgccggcggggaacaaccgcttcacctacacctgcgacgcccacaccttcaacttcctcgtcgccgatggatacgcatactgcgtcgtggcgaccgagtcggctgggcggcagattcctatggccttcctggagatgatcaaggaggatttcaacaagagatacgcagggggcaaagcagctacagcgacagcaaacagcctcagccgagatttcgggccgaggcttggagatcagatgcagtactgtagggatcacccagaggaggtgagcaggctgtccagagtgaaagctcaggtggatcaagtgaaaggcatcatgatggaaaacattgacaaggtcatagatcgcggggaacaaatcgatgggctcgtcacgaggacagagcagctgcatgaccaggctgctgatttcaggcagcaaggcgtgcgggtgcgtcgcaagatgtggtaccagaacatgaagatcaagctcatcgttctcggcatcgtcatcgcgctcatcctcatcataatcctctcaatttgccatggcacatgcaagtgatccatttagctcagatgcagtagtagctggttaattagaatgtcagttttggattcggggtgatcatcacttcactgtacaggttggtccttgaggttacactccactgtgttaaccccatcaactcttgtcctgctgtttattttcttgactattcaaacaacaattttgtgttctttggttatccggcagcgcctcgctcttaattttagattttcgctctttctttc

SEQ ID NO: 284 - protein, 222 aa, Panicum virgatum
  misc_feature: Ceres CLONE ID no.1803923
  misc_feature: Bit score of 166.2 for HMM based on sequences of FIGURE 13.
  misc_feature (130)..(218): Pfam Name: Synaptobrevin Pfam Description: Synaptobrevin
  misc_feature: Functional Homolog Of Ceres CLONE ID no. 41543 at SEQ ID NO. 160
MAQPPEGALIYAMVARGTVVVAEHTSYASNFRDIAAQCLHRLPAGNNRFTYTCDAHTFNFLVADGYAYCVVATESAGRQIPMAFLEMIKEDFNKRYAGGKAATATANSLSRDFGPRLGDQMQYCRDHPEEVSRLSRVKAQVDQVKGIMMENIDKVIDRGEQIDGLVTRTEQLHDQAADFRQQGVRVRRKMWYQNMKIKLIVLGIVIALILIIILSICHGTCK

SEQ ID NO: 285 - DNA, 700 bp, Panicum virgatum
  misc_feature: Ceres CLONE ID no.2024557
  misc_feature: Encodes the peptide sequence at SEQ ID NO 286
accaaggtcctttccccccctcctccacccgcttccccaccccaaccacctccggcgagctctacaccggcggcagcggaggagcgtgggggctgatcctaggaggcgaaagagcagcggggcggagacgaggtgatggggcagcagcagctgatctacgcgttcgtggcgcggggcacggtggtgctggccgagtacaccgagttcaccggcaacttcaccaccatcgcggcccagtgcctgcagaagctccccgccagcaacaacaagttcacatacaactgcgacggccacaccttcaactacctcgtcgaggacggattcacgtattgtgtagtcgctgttgattcagtcggccggcaaatccccattgctttcctggacagagttaaggaagatttcaccaaaaaatatggtggtgggaaagcagctactgcagcagcaaacagcttgaacagggagtttggatcaaaacttaaagagcacatgcagtactgtgtggaccaccctgaggaggtcagcaagcttgccaaggtgaaagcccaagtctcagaagttaaaggagttatgatggagaatatcgagaaggttctggaccgtggggagaagattgaactgcttgttgacaagactgaaaatctgcgttctcaggcacaagatttcaggcagcagggcaccaaggtgcggcggaagatgtggc

SEQ ID NO: 286 - protein, 188 aa, Panicum virgatum
  misc_feature: Ceres CLONE ID no.2024557
  misc_feature: Bit score of 110.9 for HMM based on sequences of FIGURE 13.
  misc_feature (127)..(188): Pfam Name: Synaptobrevin Pfam Description: Synaptobrevin
  misc_feature: Functional Homolog Of Ceres CLONE ID no. 41543 at SEQ ID NO. 160
MGQQQLIYAFVARGTVVLAEYTEFTGNFTTIAAQCLQKLPASNNKFTYNCDGHTFNYLVEDGFTYCVVAVDSVGRQIPIAFLDRVKEDFTKKYGGGKAATAAANSLNREFGSKLKEHMQYCVDHPEEVSKLAKVKAQVSEVKGVMMENIEKVLDRGEKIELLVDKTENLRSQAQDFRQQGTKVRRKMW

SEQ ID NO: 287 - DNA, 1162 bp, Panicum virgatum
  misc_feature: Ceres CLONE ID no.1820364
  misc_feature: Encodes the peptide sequence at SEQ ID NO 288
aggttttccaccgaatccttgcctcttctcggaactcaccaccgcgggaaggaaggaggagggagacgaagcagaagcagaagcttctcgcagggcgttcccgttcggcggcgtccgtggcggggcgactccgggcgccatgagcagcagcaagcaggcgctgatttacagcttcgtggccaagggctccgtcgtgctggcggagcacaccgccttctccggtaacttcagcaccgtcgccgtccagtgcctccagaagctgccccccaacagcaccagatccacctactcctgcgacggccacaccttcaacttcctcgtcgaccgcggcttcgtgttcctagtggtcgcggatgaggcggccgggaggagcgtgcccttcgtcttcctagagaaggttagggaaggcttcatgcagcgatatgggtccagcatcgacgaggaggggcagcacccgctcgctgatgatgcggacgaggacgactttcttttcgaagaccgcttcagcattgcctacaaccttgaccgtgaattcggcccgacgttgaaggatcatatgcagtattgtgttaaccacccagaggaaattaacaagctctccaaggtgaaagcccacctgtcggaggtcaaagggatcatgatggataatattgagaagatattggaccgtggtgagaagattgagcttttggtgggcaagaccgagaccttacaatcacaggctgacaccttccacaggcatggcagagagctgaggcgaaagatgtggcttcagaacctaaggtttaagctgatggttggtggaggcattgcggctctgattctcatcctttggctgatggtctgcaggggattcaaatgttagatcgctcagagttgtggctcgccctctcttttttgaagtgtttgttgcgttgttgaccgtttcacatgcacataatggtcaccgaatggtgtttcagtcatgttgtgggtatcggtatcgtgtagcggatgttaattccgtgcggtccttgccgtgtttcatatgataatagtaggcagctggagtacctgtgatagataactttgtgggagaaggggataatgacgctatgacctttattatctgtacattacaaaatgcaagctcttattattggaaaaaaaaaaaaaaaaaaaa

SEQ ID NO: 288 - protein, 241 aa, Panicum virgatum
  misc_feature: Ceres CLONE ID no.1820364
  misc_feature: Bit score of 148.0 for HMM based on sequences of FIGURE 13.
  misc_feature (149)..(237): Pfam Name: Synaptobrevin Pfam Description: Synaptobrevin
  misc_feature: Functional Homolog Of Ceres CLONE ID no. 41543 at SEQ ID NO. 160
MSSSKQALIYSFVAKGSVVLAEHTAFSGNFSTVAVQCLQKLPPNSTRSTYSCDGHTFNFLVDRGFVFLVVADEAAGRSVPFVFLEKVREGFMQRYGSSIDEEGQHPLADDADEDDFLFEDRFSIAYNLDREFGPTLKDHMQYCVNHPEEINKLSKVKAHLSEVKGIMMDNIEKILDRGEKIELLVGKTETLQSQADTFHRHGRELRRKMWLQNLRFKLMVGGGIAALILILWLMVCRGFKC

SEQ ID NO: 289 - protein, 197 aa, Oryza sativa subsp. indica
  misc_feature: Public GI ID no.125554274
  misc_feature: Bit score of 531.5 for HMM based on sequences of FIGURE 13.
  misc_feature (124)..(197): Pfam Name: Synaptobrevin Pfam Description: Synaptobrevin
  misc_feature: Functional Homolog Of Ceres CLONE ID no. 41543 at SEQ ID NO. 160
MAILYAVVARGTVVLAEHSAAATNAGAVARQVLERLPGGGADSHVSYTQDRYVFHAKRTDGITALCMADEAAGRRIPFAFLEDIHGRFVKTYGRAALTSLAYGMNDEFSRVLSQQMDYYSNDPNADRINRMRGEISQVRTVMIDNIDKVLERGDRLDMLVDKTANMQGNTIRFKRQARRFRNTTWWRNVKLTYVIFL

SEQ ID NO: 290 - protein, 223 aa, Oryza sativa subsp. indica
  misc_feature: Public GI ID no.125531165
  misc_feature: Bit score of 557.5 for HMM based on sequences of FIGURE 13.
  misc_feature (129)..(214): Pfam Name: Synaptobrevin Pfam Description: Synaptobrevin
  misc_feature: Functional Homolog Of Ceres CLONE ID no. 41543 at SEQ ID NO. 160
MAIVYAVVARGTVVLAEFSAVSGNAGAVARRILEKLPPDAESRLCFAQDRYIFHVLRSPPPTAADGLTFLCMANDTFGRRIPFLYLEDIQMRFIKNYGRIAHNALAYAMNDEFSRVLHQQMEYFSSNPSADTLNRLRGEIHTVMVDNIEKILDRGERISLLVDKTSTMQDSAFHFRKQSRRLRRALWMKNAKLLAVLTAVIVLLLYLIIAAFCGGLSLPSCRS

SEQ ID NO: 291 - protein, 274 aa, Oryza sativa subsp. indica
  misc_feature: Public GI ID no.125541514
  misc_feature: Bit score of 427.0 for HMM based on sequences of FIGURE 13.
  misc_feature (173)..(228): Pfam Name: Synaptobrevin Pfam Description: Synaptobrevin
  misc_feature: Functional Homolog Of Ceres CLONE ID no. 41543 at SEQ ID NO. 160
MGRIQYAAVARGAVVMAEHGDAAFPNAGAVARQILDRLSAGDGGGGGDCNVSYTQDLHVFHVKRTDGVTALCMADDAAGRRIPFAFLEDIHGRFVKTYGRAALTALAYAMNDEFSRVLGQQMDYYSNDPNADRISRMRGEMDQYFSYLSVVKLRVDGASYKFRKNDINENFLQVRNVMIDNIDKVLERGDRLELLVDKTATMQGNTMRFKRQARRFRNTVWWRNVKLTYVHYHHSVHQTPYEHLPLPFCLPTSLWVFVFMLHTENSLIIIYFDY

SEQ ID NO: 292 - protein, 279 aa, Oryza sativa subsp. indica
  misc_feature: Public GI ID no.125557559
  misc_feature: Bit score of 100.6 for HMM based on sequences of FIGURE 13.
  misc_feature (140)..(274): Pfam Name: Synaptobrevin Pfam Description: Synaptobrevin
  misc_feature: Functional Homolog Of Ceres CLONE ID no. 41543 at SEQ ID NO. 160
MGQQSLIYAFVARGTVVLAEYTEFTGNFTTIAAQCLQKLPASNNKFTYNCDGHTFNYLVEDGFSSNRIGILGIQGLAYCVVAVESVGRQIPIAFLDRVKEDFTKRYGGGKAATAAANSLNREFGSKLKEHMQYCVDHPEEISKLAKVKAQVSEVKGVMMENIEKVLDRGEKIELLVDKTENLRSQNSGIFIQWIAMEKLLIHVSVDRMRVWSMVMKYRIMVPKVIWLTVDMAQDFRQQGTKVRRKMWLQNMKIKLIVLGIIIALILIIILSVCHGFKCK

SEQ ID NO: 293 - protein, 322 aa, Oryza sativa subsp. indica
  misc_feature: Public GI ID no.125557844
  misc_feature: Bit score of 30.7 for HMM based on sequences of FIGURE 13.
  misc_feature (252)..(315): Pfam Name: Synaptobrevin Pfam Description: Synaptobrevin
  misc_feature: Functional Homolog Of Ceres CLONE ID no. 41543 at SEQ ID NO. 160
MASPPGKKGEGGGDGGGGKAEWLIYAFVARGTAVLAEYTEFTGNFPALAAQCLQRLPASGGGGSGGGAPARFSYACDGHTFNFLLHRGYAYCVVAKESVPKNVSVAFLERLKDDFMKRYGGGKADTALAKSLNKEYGPVIKQHMQYVLDHSEEIEKTLKVQAQVSEVKNIMLENIEKVWSTFAVGCPLFFTELILMGFLFKKVIFMLVGQQEYKTTHNIMIAITLALVSSVGDLDIRIASLFIYASLWYFQTLGRGEKLSELQDKTSDLQSQAQEFKKKGVKIRRKTWLQNMKIKLVVLGILLLLVIIVWVSVCQGFDCTKH

SEQ ID NO: 294 - protein, 221 aa, Oryza sativa subsp. japonica
  misc_feature: Public GI ID no.115466694
  misc_feature: Bit score of 646.4 for HMM based on sequences of FIGURE 13.
  misc_feature (124)..(212): Pfam Name: Synaptobrevin Pfam Description: Synaptobrevin
  misc_feature: Functional Homolog Of Ceres CLONE ID no. 41543 at SEQ ID NO. 160
MAILYAVVARGTVVLAEHSAAATNAGAVARQVLERLPGGGADSHVSYTQDRYVFHAKRTDGITALCMADEAAGRRIPFAFLEDIHGRFVKTYGRAALTSLAYGMNDEFSRVLSQQMDYYSNDPNADRINRMRGEISQVRTVMIDNIDKVLERGDRLDMLVDKTANMQGNTIRFKRQARRFRNTTWWRNVKLTIALIFLLTVIIYVVLVFMCHGFTLPTCIR

SEQ ID NO: 295 - protein, 226 aa, Oryza sativa subsp. japonica
  misc_feature: Public GI ID no.115449295
  misc_feature: Bit score of 548.0 for HMM based on sequences of FIGURE 13.
  misc_feature (130)..(218): Pfam Name: Synaptobrevin Pfam Description: Synaptobrevin
  misc_feature: Functional Homolog Of Ceres CLONE ID no. 41543 at SEQ ID NO. 160
MGRIQYAAVARGAVVMAEHGDAAFPNAGAVARQILDRLSAGDGGGGGDCNISYTQDLHVFHVKRTDGVTALCMADDAAGRRIPFAFLEDIHGRFVKTYGRAALTALAYAMNDEFSRVLGQQMDYYSNDPNADRISRMRGEMDQVRNVMIDNIDKVLERGDRLELLVDKTATMQGNTMRFKRQARRFRNTVWWRNVKLTAASVFILLVIIYIVLVYMCHGFTLPSCI

SEQ ID NO: 296 - protein, 226 aa, Oryza sativa subsp. japonica
  misc_feature: Public GI ID no.115481182
  misc_feature: Bit score of 574.4 for HMM based on sequences of FIGURE 13.
  misc_feature (129)..(217): Pfam Name: Synaptobrevin Pfam Description: Synaptobrevin
  misc_feature: Functional Homolog Of Ceres CLONE ID no. 41543 at SEQ ID NO. 160
MAIVYAVVARGTVVLAEFSAVSGNAGAVARRILEKLPPDAESRLCFAQDRYIFHVLRSPPPAAADGLTFLCMANDTFGRRIPFLYLEDIQMRFIKNYGRIAHNALAYAMNDEFSRVLHQQMEYFSSNPSADTLNRLRGEVSEIHTVMVDNIEKILDRGERISLLVDKTSTMQDSAFHFRKQSRRLRRALWMKNAKLLAVLTAVIVLLLYLIIAAFCGGLSLPSCRS

SEQ ID NO: 297 - protein, 223 aa, Oryza sativa subsp. japonica
  misc_feature: Public GI ID no.20177639
  misc_feature: Bit score of 557.0 for HMM based on sequences of FIGURE 13.
  misc_feature (129)..(214): Pfam Name: Synaptobrevin Pfam Description: Synaptobrevin
  misc_feature: Functional Homolog Of Ceres CLONE ID no. 41543 at SEQ ID NO. 160
MAIVYAVVARGTVVLAEFSAVSGNAGAVARRILEKLPPDAESRLCFAQDRYIFHVLRSPPPAAADGLTFLCMANDTFGRRIPFLYLEDIQMRFIKNYGRIAHNALAYAMNDEFSRVLHQQMEYFSSNPSADTLNRLRGEIHTVMVDNIEKILDRGERISLLVDKTSTMQDSAFHFRKQSRRLRRALWMKNAKLLAVLTAVIVLLLYLIIAAFCGGLSLPSCRS

SEQ ID NO: 298 - protein, 220 aa, Oryza sativa subsp. japonica
  misc_feature: Public GI ID no.115471021
  misc_feature: Bit score of 186.7 for HMM based on sequences of FIGURE 13.
  misc_feature (127)..(215): Pfam Name: Synaptobrevin Pfam Description: Synaptobrevin
  misc_feature: Functional Homolog Of Ceres CLONE ID no. 41543 at SEQ ID NO. 160
MGQQSLIYAFVARGTVVLAEYTEFTGNFTTIAAQCLQKLPASNNKFTYNCDGHTFNYLVEDGFTYCVVAVESVGRQIPIAFLDRVKEDFTKRYGGGKAATAAANSLNREFGSKLKEHMQYCVDHPEEISKLAKVKAQVSEVKGVMMENIEKVLDRGEKIELLVDKTENLRSQAQDFRQQGTKVRRKMWLQNMKIKLIVLGIIIALILIIILSVCHGFKCK

SEQ ID NO: 299 - protein, 220 aa, Oryza sativa subsp. japonica
  misc_feature: Public GI ID no.115456011
  misc_feature: Bit score of 171.1 for HMM based on sequences of FIGURE 13.
  misc_feature (127)..(215): Pfam Name: Synaptobrevin Pfam Description: Synaptobrevin
  misc_feature: Functional Homolog Of Ceres CLONE ID no. 41543 at SEQ ID NO. 160
MGQQSLIYAFVARGTVILAEYTEFTGNFTTIASQCLMKLPASNNKFTYNCDGHTFNYLVEDGFTYCVVAVESVGRQIPIAFLDRVKDDFTKRYAGGKAATAAANSLNRDFGSKLKEHMQYCVDHPEEISKLAKVKAQVSEVKGVMMENIEKVLDRGEKIELLVDKTENLRSQAQDFRQAGTQVRRKMWLQNMKIKLIVLGIIIALILIIILSVCHGFKCK

SEQ ID NO: 300 - protein, 346 aa, Oryza sativa subsp. japonica
  misc_feature: Public GI ID no.125588290
  misc_feature: Bit score of 103.4 for HMM based on sequences of FIGURE 13.
  misc_feature (127)..(189): Pfam Name: Synaptobrevin Pfam Description: Synaptobrevin
  misc_feature: Functional Homolog Of Ceres CLONE ID no. 41543 at SEQ ID NO. 160
MGQQSLIYAFVARGTVILAEYTEFTGNFTTIASQCLMKLPASNNKFTYNCDGHTFNYLVEDGFTYCVVAVESVGRQIPIAFLDRVKDDFTKRYAGGKAATAAANSLNRDFGSKLKEHMQYCVDHPEEISKLAKVKAQVSEVKGVMMENIEKVLDRGEKIELLVDKTENLRSQAQDFRQAGTQGTRRQTLGEILMDPDGSVAARANPHALPSPTLVLANPDECSALILPSSYRKLFSSAANLRPPAYAASQLPALICGLSAQLPALCCQVINGASCGASRRGVRPSFIRSHCATATCTTSSTDGWTNGVRETVIHVKAHHFATSLGLAPPPTSPSSGGVRARGVEWP

SEQ ID NO: 301 - protein, 241 aa, Oryza sativa subsp. japonica
  misc_feature: Public GI ID no.115477799
  misc_feature: Bit score of 130.1 for HMM based on sequences of FIGURE 13.
  misc_feature (149)..(237): Pfam Name: Synaptobrevin Pfam Description: Synaptobrevin
  misc_feature: Functional Homolog Of Ceres CLONE ID no. 41543 at SEQ ID NO. 160
MNGNKQSLIYSFVAKGSVVLAEHTAFSGNFSTIAVQCLQKLPPNTSKSTYSCDGHTFNFLVDRGFVFLVVADEAVGRSVPFVFLDRVKEDFMQRYGSSIDEEGQHPLADDADDDDFLLEDRFSIAYNLDREFGPRLKDHMLYCINHPEEISKLSKVKAHLTEVKGIMMDNIEKILERGEKIELLVGKTETLQSQADSFHRHGRELRRKMWLQNLRFKLMVGGAVAALILFLWLIICGGFKC

SEQ ID NO: 302 - protein, 248 aa, Oryza sativa subsp. japonica
  misc_feature: Public GI ID no.115471385
  misc_feature: Bit score of 128.1 for HMM based on sequences of FIGURE 13.
  misc_feature (153)..(241): Pfam Name: Synaptobrevin Pfam Description: Synaptobrevin
  misc_feature: Functional Homolog Of Ceres CLONE ID no. 41543 at SEQ ID NO. 160
MASPPGKKGEGGGDGGGGKAEWLIYAFVARGTAVLAEYTEFTGNFPALAAQCLQRLPASGGGGSGGGAPARFSYACDGHTFNFLLHRGYAYCVVAKESVPKNVSVAFLERLKDDFMKRYGGGKADTALAKSLNKEYGPVIKQHMQYVLDHSEEIEKTLKVQAQVSEVKNIMLENIEKTLGRGEKLSELQDKTSDLQSQAQEFKKKGVKIRRKTWLQNMKIKLVVLGILLLLVIIVWVSVCQGFDCTKH

SEQ ID NO: 303 - protein, 273 aa, Oryza sativa subsp. japonica
  misc_feature: Public GI ID no.125599705
  misc_feature: Bit score of 94.1 for HMM based on sequences of FIGURE 13.
  misc_feature (153)..(266): Pfam Name: Synaptobrevin Pfam Description: Synaptobrevin
  misc_feature: Functional Homolog Of Ceres CLONE ID no. 41543 at SEQ ID NO. 160
MASPPGKKGEGGGDGGGGKAEWLIYAFVARGTAVLAEYTEFTGNFPALAAQCLQRLPASGGGGSGGGAPARFSYACDGHTFNFLLHRGYAYCVVAKESVPKNVSVAFLERLKDDFMKRYGGGKADTALAKSLNKEYGPVIKQHMQYVLDHSEEIEKTLKVQAQVSEVKNIMLENIEKVWSTFAVGCPLFFTELILMGFLFKKTLGRGEKLSELQDKTSDLQSQAQEFKKKGVKIRRKTWLQNMKIKLVVLGILLLLVIIVWVSVCQGFDCTKH

SEQ ID NO: 304 - protein, 179 aa, Oryza sativa subsp. japonica
  misc_feature: Public GI ID no.115489810
  misc_feature: Bit score of 71.1 for HMM based on sequences of FIGURE 13.
  misc_feature (108)..(175): Pfam Name: Synaptobrevin Pfam Description: Synaptobrevin
  misc_feature: Functional Homolog Of Ceres CLONE ID no. 41543 at SEQ ID NO. 160
MAESKLIYAMVARGTVVLAEHTAYAGNFRDIAAQCLQKLPAGDNRLTYTCDAHTFNFLIHQGYAYCVVATESSGRQIPLALLDMIKEDFNKRPRLGEQMKYCMDHPEEVSKLAKVKAQVSEVKGIMMENIDKAADFRQQGTRVRRKMWYQNMKIKLIVLGIIIALILIIILSVCHGFKC

SEQ ID NO: 305 - protein, 215 aa, Hordeum vulgare subsp. vulgare
  misc_feature: Public GI ID no.55276718
  misc_feature: Bit score of 142.5 for HMM based on sequences of FIGURE 13.
  misc_feature (122)..(210): Pfam Name: Synaptobrevin Pfam Description: Synaptobrevin
  misc_feature: Functional Homolog Of Ceres CLONE ID no. 41543 at SEQ ID NO. 160
MIYAMVARGTVVVAEHTAYTGNFRDIAGQCLHKLPAGDSRFAYNCDGHTFTFLLHQGYAYCVVATESAGREVPLAFLERIKEDFNRRYAGGKAATATANSLTKDFGPRLKEQMKYCMDHPEEVSRLSKVQAQVSEVKGIMMENIDKVIDRGEQIDGLVTRTEQLHDHALDFRTEGTRIRRRMWYQNMKIKLIVVGIVVALILIIVLSICHKKDCN

SEQ ID NO: 306 - DNA, 666 bp, Sorghum bicolor
  misc_feature: Ceres ANNOT ID no.6025568
  misc_feature: Encodes the peptide sequence at SEQ ID NO 307
atggcgatcctgtacgcgctggtggcgcgcggcacggtggtgctggcggagcacagcgcggcggccaccaacgcgggcgccatcgcgcgccaggtcctcgagcgcctccccgacggcggcgccgacagccacgtctcctacacgcaggaccgctacgtcttccacgccaagcgcaccgacggcatcaccgcgctctgcatggccgacgactccgccggaagacggattcccttcgcatttttggaagatattcacggaaggtttgtcaagacatatggccgggctgcgctgacggctcttgcatatgcaatgaatgatgaattctcaagggtcttgagccaacaaatggactactattcaaatgaccctaatgcagatagaataaaccgcatgagaggtgaaatcaatcaggtccgtagtgttatgattgataacattgataaggtccttgaaagaggtgatcgtttggaactgctggttgacaagactgcgaatatgcaaggaaatacagttcgattcaaaagacaagctcggcggttcagaaacactacttggtggagaaatgtcaaactcacggccgcattgatacttctcctcctggtaataatatatgtcgttcttgtgttcatgtgccatggtttcaccctaccaacttgcataaggtaa

SEQ ID NO: 307 - protein, 221 aa, Sorghum bicolor
  misc_feature: Ceres ANNOT ID no.6025568
  misc_feature: Bit score of 652.9 for HMM based on sequences of FIGURE 13.
  misc_feature (124)..(212): Pfam Name: Synaptobrevin Pfam Description: Synaptobrevin
  misc_feature: Functional Homolog Of Ceres CLONE ID no. 41543 at SEQ ID NO. 160
MAILYALVARGTVVLAEHSAAATNAGAIARQVLERLPDGGADSHVSYTQDRYVFHAKRTDGITALCMADDSAGRRIPFAFLEDIHGRFVKTYGRAALTALAYAMNDEFSRVLSQQMDYYSNDPNADRINRMRGEINQVRSVMIDNIDKVLERGDRLELLVDKTANMQGNTVRFKRQARRFRNTTWWRNVKLTAALILLLLVIIYVVLVFMCHGFTLPTCIR

SEQ ID NO: 308 - DNA, 687 bp, Sorghum bicolor
  misc_feature: Ceres ANNOT ID no.6091128
  misc_feature: Encodes the peptide sequence at SEQ ID NO 309
atgggcaagatcgagtacgccgtggtggcgcgcggtgcggtggtgctggcggagcactacggcgcgtcggcggcgggcggcaacgcgggcgccgtggcgaggcaggtcctcgagcgcctccccgccggcggcgccggtggcgacgactgcaacgtctcgtacacgcaggacctccacgtgttccacgtcaagcgcaccgacggcctcaccgcgctctgcatggccgacgacgccgccgggcggcgtgttccgttcgcgttcctggaggacatccacgggaggttcgtcaaggcgtacggccgcgcggcgctcaccgcgctcgcgtacgccatgaacgacgagttctccagggttctggcccagcagatggactactactccaacgacgccagcgcggacaggataaaccgcatgaggggtgagatcgaccaggtccggaacgtgatgatagacaacatcgacagggtgctggagaggggtgagcgtctggagctgctggtggacaagacggcaaccatgcaggggaacaccatgcgcttcaagcgccaagctcgccgcttcaggaacaccatgtggtggaggaacgtcaagctcaccgccgcggtgatattcatcctcaccgtaatattgtacctcgtgctcgcctacatgtgtcacggcttcaccctaccatcctgtgttccgtga

SEQ ID NO: 309 - protein, 228 aa, Sorghum bicolor
  misc_feature: Ceres ANNOT ID no.6091128
  misc_feature: Bit score of 555.3 for HMM based on sequences of FIGURE 13.
  misc_feature (131)..(219): Pfam Name: Synaptobrevin Pfam Description: Synaptobrevin
  misc_feature: Functional Homolog Of Ceres CLONE ID no. 41543 at SEQ ID NO. 160
MGKIEYAVVARGAVVLAEHYGASAAGGNAGAVARQVLERLPAGGAGGDDCNVSYTQDLHVFHVKRTDGLTALCMADDAAGRRVPFAFLEDIHGRFVKAYGRAALTALAYAMNDEFSRVLAQQMDYYSNDASADRINRMRGEIDQVRNVMIDNIDRVLERGERLELLVDKTATMQGNTMRFKRQARRFRNTMWWRNVKLTAAVIFILTVILYLVLAYMCHGFTLPSCVP

SEQ ID NO: 310 - DNA, 2869 bp, Arabidopsis thaliana
  misc_feature: Ceres LOCUS ID no.At1g32330
  misc_feature: Genomic Sequence
  misc_feature: Expected Sequence
  misc_feature: Encodes the peptide sequence at SEQ ID NO. 311
atggatgtgagcaaagtaaccacaagcgacggcggaggagattcaatggagactaagccatctcctcaacctcagcctgcggcgattctaagttcaaacgcgcctcctccgtttctgagcaagacctatgatatggttgatgatcacaatacagattcgattgtctcttggagtgctaataacaacagttttatcgtttggaaaccaccggagttcgctcgcgatcttcttcctaagaactttaagcataataatttctccagcttcgttagacagcttaatacctatgtaatcttcttccctttcccttcgccttttttttttacttcatcatttctcgattttatggattttgttccattaatgttgttcccatggttgctttatgtttctgagcagaggagttttgtatccattagaatcgatagttagtttcatgagtatgctttttagagactactttatttgcaatacttgatatcttgtgattgtttagtttagaacctcacggctttgaaatgatagatatgtgagagcgttgatgaagctgactgtacatacaaacttagggggatgagaatagagatgtatacccttttttttttgtctttgttgtctgtttgactctctgtaatcaggtttagtaatagtcgtaagatagtaataaaccttcctgaattttctcagcattcattataaaggagaagaaagaagaaatttggaataagagagcaagtctcatgttgatcatgacctgagtgcaaggttatcaactttctgttttactaatctatcattttgttgtagatgagtcaaggtttagtggagatatctcacgtctttgaaaaccttaaaaggccaatgtgatcaggagtgcctggaatagaaactagatcttaagtagatatatgggtgtttagtgttggaatatctatattgttattagtgtgactttaaatctttatctggcatgtcagttacgggaaccataggtttgctctgtacggttgcacttagattaaatactttttattcatataggctggatggagattttattgtgtatataagtagataactatataagctttgctctaaaggtcatggtgaatggagcttgtactgcataatatttagagcaggatgctcgtgatgctgcaagatggtgaatgcacttaaaggagcttgaattttctgctgacagttcttgtttgccagttattccttagttactgtctgtgtggtacatgatgtcttacatgttgggcactatttgaagcaaaattcaatctttatgagtttataccatgcagactttgacataaagattacactggtagatcatagatacttttcaccctcttagttttcagttatccctattagatattttggtttttcctcggtttgggtggtaggtaagacccataataggaacataaataaagtagttttcatgattcatatattaaattgaccatgattggtcatttacttgacttctgaattaaaattgctcttgatgcatgtgccaactgatcagttacgtcctgtatatggctgtttcaatctgtggatagttggcagttaaaagactatgtgttgaaggttttagatttgcacttctaaagctgtcggatgaattctttctcattggtcttggtggaatccattttcattccattttgcgtgtcttttcttgatacagggtttcaggaaggttgacccagatagatgggaatttgcgaatgaaggttttttaagaggtcagaagcacttgctacaatcaataactaggcgaaaacctgcccatggacagggacagggacatcagcgatctcagcactcgaatggacagaactcatctgttagcgcatgtgttgaagttggcaaatttggtctcgaagaagaagttgaaaggcttaaaagagataagaacgtccttatgcaagaactcgtcagattaagacagcagcaacagtccactgataaccaacttcaaacgatggttcagcgtctccagggcatggagaatcggcaacaacaattaatgtcattccttgcaaaggcagtacaaagccctcattttctatctcaattcttacagcagcagaatcagcaaaacgagagtaataggcgcatcagtgataccagtaagaagcggagattcaagcgagacggcattgtccgtaataatgattctgctactcctgatggacagatagtgaagtatcaacctccaatgcacgagcaagccaaagcaatgtttaaacagcttatgaagatggaaccttacaaaaccggcgatgatggtttccttctaggtaatggtacgtctactaccgagggaacagagatggagacttcatcaaaccaagtatcgggtataactcttaaggaaatgcctacagcttctgagatacagtcatcatcaccaattgaaacaactcctgaaaatgtttcggcagcatcagaagcaaccgagaactgtattccttcacctgatgatctaactcttcccgacttcactcatatgctaccggaaaataattcagagaagcctccagagagtttcatggaaccaaacctgggaggttctagtccattactagatccagatctgttgatcgatgattctttgtccttcgacattgacgactttccaatggattctgatatagaccctgttgattacggtttactcgaacgcttactcatgtcaagcccggttccagataatatggattcaacaccagtggacaatgaaacagagcaggaacaaaatggatgggacaaaactaagcatatggataatctgactcaacagatgggtctcctctctcctgaaaccttagatctctcaaggtaa

SEQ ID NO: 311 - protein, 485 aa, Arabidopsis thaliana
  misc_feature: Ceres LOCUS ID no.At1g32330
  misc_feature: Bit score of 1272.2 for HMM based on sequences of FIGURE 12.
  misc_feature (36)..(214): Pfam Name: HSF_DNA-bind Pfam Description: HSF-type DNA-binding
MDVSKVTTSDGGGDSMETKPSPQPQPAAILSSNAPPPFLSKTYDMVDDHNTDSIVSWSANNNSFIVWKPPEFARDLLPKNFKHNNFSSFVRQLNTYGFRKVDPDRWEFANEGFLRGQKHLLQSITRRKPAHGQGQGHQRSQHSNGQNSSVSACVEVGKFGLEEEVERLKRDKNVLMQELVRLRQQQQSTDNQLQTMVQRLQGMENRQQQLMSFLAKAVQSPHFLSQFLQQQNQQNESNRRISDTSKKRRFKRDGIVRNNDSATPDGQIVKYQPPMHEQAKAMFKQLMKMEPYKTGDDGFLLGNGTSTTEGTEMETSSNQVSGITLKEMPTASEIQSSSPIETTPENVSAASEATENCIPSPDDLTLPDFTHMLPENNSEKPPESFMEPNLGGSSPLLDPDLLIDDSLSFDIDDFPMDSDIDPVDYGLLERLLMSSPVPDNMDSTPVDNETEQEQNGWDKTKHMDNLTQQMGLLSPETLDLSRQNP

SEQ ID NO: 312 - protein, 341 aa, Oryza sativa subsp. indica
  misc_feature: Public GI ID no.125546035
  misc_feature: Bit score of 136.6 for HMM based on sequences of FIGURE 12.
  misc_feature (37)..(178): Pfam Name: HSF_DNA-bind Pfam Description: HSF-type DNA-binding
  misc_feature: Functional Homolog Of Ceres LOCUS ID no. At1g32330 at SEQ ID NO. 311
MNYRVVNPVKVESGPSTGVANGQPPRPMDGLADGGPPPFLTKTYDMVDDPTTDAVVSWSATNNSFVVWDPHLFGNVLLPRYFKHNNFSSFVRQLNTYGFRKVDPDKWEFANEGFLRGQKHLLKSIKRRKPPNSSPSQQSLGSFLEVGHFGYEGEIDQLKRDKHLLMAEVVKLRQEQQTQVRPASYGTELQVMHNPEFIRQLFSQSEMRKELEEFVSKKRRRRIDQGPELDSMGTGSSPEQVSQVMFEPHDPVDSLFNGVPSDLESSSVEANGGKAQQDVASSSSEHGKIKPSNGELNEDFWEDLLHEGGLDEDTRNPAIDDMNLLSQKMGYLNSSSTKSSQ

SEQ ID NO: 313 - DNA, 1233 bp, Arabidopsis thaliana
  misc_feature: Ceres CLONE ID no.125228
  misc_feature: Encodes the peptide sequence at SEQ ID NO 314
tctaaagtttagagatttttcgattatggtgaaatcgacggacggtggtggtgggtcttcttcttcttcttcttcagtggcgccgttcttgagaaaatgttacgatatggttgatgattctactactgactctataatctcatggagtccaagtgcagataatagcttcgttatcttggacaccaccgtcttctctgttcaactcttgcctaaatactttaaacacagcaatttctctagctttattcgtcagctcaatatctacggttttagaaaagttgatgcagatcgatgggagtatgcgaatgacgggtttgtgagaggtcaaaaggatttgctgaagaatgttatcaggaggaagaatgttcaaagtagtgagcagagcaaacatgagagtacaagtacaacatatgctcaggaaaagagtggattgtggaaggaagttgatattttgaaaggtgataagcaggtattggcgcaggagttgatcaaagttaggcagtatcaggaggtgacggatactaagatgttacatttagaagacagagttcaaggaatggaagagagtcagcaggagatgctttcgtttttggttatggttatgaagaatccaagtcttttagttcagttacttcagccaaaggagaaaaacacttggcgaaaagcggcggaaggagcgaagattgtggaagaagtgactgatgaaggagaatcaaactcatatggtcttcctttagtaacataccagccaccatcggacaacaatggaactgcaaagtcaaactcgaacgacgtaaatgatttcttgagaaacgccgatatgttgaagttctgcttagatgaaaaccatgtgccattgatcatacctgatctatacgatgatggagcatgggaaaagcttttgttgttgagcccttcaaggaagaagacgaagaagcaggagaacattgtgaagaaaggaaaggatgatttgacattggaggaggaggaggaggatggaacaatggaattagacaagagctatatgcttaagctgatatcagaagagatggagaaaccagatgactttgaatttggacagcttactcctgagaggtctaggaaccttgagattttgacagagcagatggaattgctggcttcaaatgaatagttgattttttgaacatatcagcctcaaaacttttgttatgtaactctataacgaacaacgaagtatgcaccggatatatc

SEQ ID NO: 314 - protein, 375 aa, Arabidopsis thaliana
  misc_feature: Ceres CLONE ID no.125228
  misc_feature: Bit score of 55.3 for HMM based on sequences of FIGURE 12.
  misc_feature (19)..(189): Pfam Name: HSF_DNA-bind Pfam Description: HSF-type DNA-binding
  misc_feature: Functional Homolog Of Ceres LOCUS ID no. At1g32330 at SEQ ID NO. 311
MVKSTDGGGGSSSSSSSVAPFLRKCYDMVDDSTTDSIISWSPSADNSFVILDTTVFSVQLLPKYFKHSNFSSFIRQLNIYGFRKVDADRWEYANDGFVRGQKDLLKNVIRRKNVQSSEQSKHESTSTTYAQEKSGLWKEVDILKGDKQVLAQELIKVRQYQEVTDTKMLHLEDRVQGMEESQQEMLSFLVMVMKNPSLLVQLLQPKEKNTWRKAAEGAKIVEEVTDEGESNSYGLPLVTYQPPSDNNGTAKSNSNDVNDFLRNADMLKFCLDENHVPLIIPDLYDDGAWEKLLLLSPSRKKTKKQENIVKKGKDDLTLEEEEEDGTMELDKSYMLKLISEEMEKPDDFEFGQLTPERSRNLEILTEQMELLASNE

SEQ ID NO: 315 - protein, 459 aa, Oryza sativa subsp. japonica
  misc_feature: Public GI ID no.115465055
  misc_feature: Bit score of 108.1 for HMM based on sequences of FIGURE 12.
  misc_feature (19)..(187): Pfam Name: HSF_DNA-bind Pfam Description: HSF-type DNA-binding
  misc_feature: Functional Homolog Of Ceres LOCUS ID no. At1g32330 at SEQ ID NO. 311
MESSNLGGGGGGGGGGGPPPFLIKTYEMVEDAATNHVVSWGPGGASFVVWNPLDFSRDLLPKYFKHNNFSSFIRQLNTYGFRKIDPERWEFANEDFIRGHTHLLKNIHRRKPVHSHSLQNQINGPLAESERRELEEEINRLKYEKSILVADLQRQNQQQYVINWQMQAMEGRLVAMEQRQKNIVASLCEMLQRRGGAVSSSLLESDHFSKKRRVPKMDLFVDDCAAGEEQKVFQFQGIGTDAPAMPPVLPVTNGEAFDRVELSLVSLEKLFQRANDACTAAEEMYSHGHGGTEPSTAICPEEMNTAPMETGIDLQLPASLHPSSPNTGNAHLHLSTELTESPGFVQSPELPMAEIREDIHVTRYPTQADVNSEIASSTDTSQDGTSETEASHGPTNDVFWERFLTETPRSCLDESERQESPKDDVKAELGCNGFHHREKVDQITEQMGHLASAEQTLHT

SEQ ID NO: 316 - protein, 457 aa, Oryza sativa subsp. indica
  misc_feature: Public GI ID no.125553080
  misc_feature: Bit score of 105.1 for HMM based on sequences of FIGURE 12.
  misc_feature (17)..(185): Pfam Name: HSF_DNA-bind Pfam Description: HSF-type DNA-binding
  misc_feature: Functional Homolog Of Ceres LOCUS ID no. At1g32330 at SEQ ID NO. 311
MESSNLGGGGGGGGGPPPFLIKTYEMVEDAATNHVVSWGPGGASFVVWNPLDFSRDLLPKYFKHNNFSSFIRQLNTYGFRKIDPERWEFANEDFIRGHTHLLKNIHRRKPVHSHSLQNQINGPLAESERRELEEEINRLKYEKSILVADLQRQNQQQYVINWQMQAMEGRLVAMEQRQKNIVASLCEMLQRRGGAVSSSLLESDHFSKKRRVPKMDLFVDDCAAGEEQKVFQFQGIGTDAPAMPPVLPVTNGEAFDRVELSLVSLEKLFQRANDACTAAEEMYSHGHGGTEPSTAICPEEMNTAPMETGIDLQLPASLHPSSPNTGNAHLHLSTELTESPGFVQSPELPMAEIREDIHVTRYPTQADVNSEIASSTDTSQDGTSETEASHGPTNDVFWERFLTETPRSCLDESERQESPKDDVKAELGCNGFHHREKVDQITEQMGHLASAEQTLHT

SEQ ID NO: 317 - protein, 482 aa, Arabidopsis thaliana
  misc_feature: Public GI ID no.8920606
  misc_feature: Bit score of 1258.2 for HMM based on sequences of FIGURE 12.
  misc_feature (36)..(214): Pfam Name: HSF_DNA-bind Pfam Description: HSF-type DNA-binding
  misc_feature: Functional Homolog Of Ceres LOCUS ID no. At1g32330 at SEQ ID NO. 311
MDVSKVTTSDGGGDSMETKPSPQPQPAAILSSNAPPPFLSKTYDMVDDHNTDSIVSWSANNNSFIVWKPPEFARDLLPKNFKHNNFSSFVRQLNTYGFRKVDPDRWEFANEGFLRGQKHLLQSITRRKPAHGQGQGHQRSQHSNGQNSSVSACVEVGKFGLEEEVERLKRDKNVLMQELVRLRQQQQSTDNQLQTMVQRLQGMENRQQQLMSFLAKAVQSPHFLSQFLQQQNQQNESNRRISDTSKKRRFKRDGIVRNNDSATPDGQIVKYQPPMHEQAKAMFKQLMKMEPYKTGDDGFLLGNGTSTTEGTEMETSSNQVSGITLKEMPTASEIQSSSPIETTPENVSAASEATENCIPSPDDLTLPDFTHMLPENNSEKPPESFMEPNLGGSSPLLDPDLLIDDSLSFDIDDFPMDSDIDPVDYGLLERLLMSSPVPDNMDSTPVDNETEQEQNGWDKTKHMDNLTQQMGLLSPETLDLSR

SEQ ID NO: 318 - DNA, 1533 bp, Populus balsamifera subsp. trichocarpa
  misc_feature: Ceres ANNOT ID no.1538958
  misc_feature: Encodes the peptide sequence at SEQ ID NO 319
atggatggaataaacaccactgcaagcggtggcgacgcctctactagcggcggtgtagcactagcggcgccggtgccgatggcgtcccagtcaaattctccgccgccatttctgagtaagacttacgacatggtagacgacccggagaccgacgccgtggtgtcttggagttcgacgaataatagttttgtggtttggaatccgccggagttcgctcgcgatcttttgccgaagtattttaagcataataacttctccagctttgttaggcaacttaatacatacggttttcgaaaggtggatccagaccgttgggaattcgccaatgaaggatttttgaggggtcagaagcacctgcttaggactatcagtcggcgaaaacctgcccatggacatactaatcaacagccgcaacaagctcgtggacagaactcaactgttggcgcttgtgttgaggttggaaaatttgggcttgaggaagaggtagagaggcttaagagggacaagaatgttcttatgcaagaacttgttaggttgaggcagcagcaacagtccacggatagccagttgcaaaccatggtgcagcgacttcaagggatggagcagcgtcagcaacagatgatgtcattcctggcaaaggctatgcagagcccgggcttcctggctcagtttgtacagcagcaaaatgaaagcagcaggcgcataacagaagccaacaaaaaacgaaggctcaagcctgaggatgtttctgagaatgagggttctagtgctcctgatggacagattgtgaagtatcagcctcagatgaacgaggcagccaaagcaatgctcaggcaggtcatgaaaatggatgctccttctaggttggaatcttatgacaccaatcttgatggcttcctgattggtaatggttcaccatcatctagtgcaaaagacagcggaagctcttcaagccgcatgtcaggagtgactcttcaagaggtcccagcagcttcagggatttccggacatggccccatggctgccatatctgaaatacaatcttccccacacattgctagctcagaaaaggctacagcttctcagtttccggaaagtatactggttggaggacaaggagcaccctccatacctattccacaggcagatataatcatgccccaggtttctcaaaagccagaaatggtgccagaaattattgctgatattcctggtgaagattacatggaaccagagacaagcagtgatgtgttcctagatccagcttcacttggaattaatgatacaatacccatagatattgacaacatctcccctgatcctgatatcgatgctttgcttgataattctagcttctgggatgaccttcttgcgcagagtccagtgcctgaggatattgaatcaagttctgtggagggtaaagccaatggaaatgatgtacatcaaattataaacgggtgggacaaagctcagcatatggatcagctgacagaacaaatgggacttctctcatcagatcgcaagcagctttaa

SEQ ID NO: 319 - protein, 510 aa, Populus balsamifera subsp. trichocarpa
  misc_feature: Ceres ANNOT ID no.1538958
  misc_feature: Bit score of 1418.7 for HMM based on sequences of FIGURE 12.
  misc_feature (35)..(211): Pfam Name: HSF_DNA-bind Pfam Description: HSF-type DNA-binding
  misc_feature: Functional Homolog Of Ceres LOCUS ID no. At1g32330 at SEQ ID NO. 311
MDGINTTASGGDASTSGGVALAAPVPMASQSNSPPPFLSKTYDMVDDPETDAVVSWSSTNNSFVVWNPPEFARDLLPKYFKHNNFSSFVRQLNTYGFRKVDPDRWEFANEGFLRGQKHLLRTISRRKPAHGHTNQQPQQARGQNSTVGACVEVGKFGLEEEVERLKRDKNVLMQELVRLRQQQQSTDSQLQTMVQRLQGMEQRQQQMMSFLAKAMQSPGFLAQFVQQQNESSRRITEANKKRRLKPEDVSENEGSSAPDGQIVKYQPQMNEAAKAMLRQVMKMDAPSRLESYDTNLDGFLIGNGSPSSSAKDSGSSSSRMSGVTLQEVPAASGISGHGPMAAISEIQSSPHIASSEKATASQFPESILVGGQGAPSIPIPQADIIMPQVSQKPEMVPEIIADIPGEDYMEPETSSDVFLDPASLGINDTIPIDIDNISPDPDIDALLDNSSFWDDLLAQSPVPEDIESSSVEGKANGNDVHQIINGWDKAQHMDQLTEQMGLLSSDRKQL

SEQ ID NO: 320 - protein, 502 aa, Medicago sativa
  misc_feature: Public GI ID no.115521213
  misc_feature: Bit score of 1404.6 for HMM based on sequences of FIGURE 12.
  misc_feature (31)..(207): Pfam Name: HSF_DNA-bind Pfam Description: HSF-type DNA-binding
  misc_feature: Functional Homolog Of Ceres LOCUS ID no. At1g32330 at SEQ ID NO. 311
MDGASGGSGGGEGSTTQIPAPTPMLNANAPPPFLSKTYDMVDDPSTDAIVSWSATNNSFVVWDPPEFARDLLPKFFKHNNFSSFVRQLNTYGFRKVDPDRWEFANEGFLRGQKQLLKSISRRKPAHGHTQQQAQQPHGQSSSVGACVEVGKFGLEEEVERLKRDKNVLMQELVRLRQQQQTTDGQLQTMVQRLQGMEQRQQQMMSFLAKAVQSPGFFAQFVQQQNDSNRRITEVNKKRRLKQDGIAETTEQATPPDGQIVKYQPMMNETAKAMLRKIMKWDTPRVESFNKNPDNYLIGDGTSPSSAMDSSSSTSWNSGVTLQEVPPSSVQSTQIPVSTGTQGHIPSAEKPEILSVPQAAASANVMKDGTHAASTIPTSQADVIMPDIPSVPEIVPKSILDIPEDNYMAPETDDGFMDPSSLGSLPIDLDCLSPGADIDDLLSNSIWDDLLQTPIPEDFEANIDEISRGNEVQPTENGWDNNTQPLDQLTEQMGLLSSDAKRI

SEQ ID NO: 321 - protein, 510 aa, Glycine max
  misc_feature: Public GI ID no.42415865
  misc_feature: Bit score of 1425.6 for HMM based on sequences of FIGURE 12.
  misc_feature (29)..(204): Pfam Name: HSF_DNA-bind Pfam Description: HSF-type DNA-binding
  misc_feature: Functional Homolog Of Ceres LOCUS ID no. At1g32330 at SEQ ID NO. 311
MDGRASSSVGGEASPAPAPVPITNANAPPPFLSKTYEMVEDPSTDSIVSWSPTNNSFVVWNPPEFARDLLPKHFKHNNFSSFVRQLNTYGFRKVDPDRWEFANEGFLRGQKHLLKTITRRKPAHGHNQQAQQAHGQSSSVGACVEVGKFGLEEEVEILKRDKNVLMQELVRLRQQQQATDNQLQSMVQRLQGMEQRQQQMMSFLAKAVQSPGFLAQFVQQQNESSRRITEANKKRRLKQEGIGEMEHTAASDGQIVKYQPLINEAAKAMLRQMMKLDTSRLESFSNNADNYLIGDHSSSSGATDRGNSLSRTSGVTLQVVPLTTIQSSHIPSATGIGDDPSTGKSEILSTPQVVACDEVTKAQYSNVNVSVGESNAPAIPATQTDEIMRDLSTIPDIVAGNILDIPQENYMAPETGGEGYMDPTSFGVNVSLPIDFDSISPEADIDDLLNNPHFWDDILRTPVSEEIDTNDAEVFKENEVQPMENGLDESQNMDQLTEQMGLLSSDAKRI

SEQ ID NO: 322 - protein, 527 aa, Lycopersicon peruvianum
  misc_feature: Public GI ID no.729775
  misc_feature: Bit score of 1421.4 for HMM based on sequences of FIGURE 12.
  misc_feature (40)..(225): Pfam Name: HSF_DNA-bind Pfam Description: HSF-type DNA-binding
  misc_feature: Functional Homolog Of Ceres LOCUS ID no. At1g32330 at SEQ ID NO. 311
MEPNSSGSGKAAVGDGGGGGAPMLQPAPAPAPMPSANAPPPFLVKTYDMVDDPSTDKIVSWSPTNNSFVVWDPPEFAKDLLPKYFKHNNFSSFVRQLNTYGFRKVDPDRWEFANEGFLRGQKHLLKSISRRKPAHGHAQQQQQPHGHAQQQMQPPGHSASVGACVEVGKFGLEEEVERLKRDKNVLMQELVRLRQQQQSTDNQLQGMVQRLQGMELRQQQMMSFLAKAVNSPGFLAQFVQQQNESNKRIAEGSKKRRIKQDIESQDPSVTPADGQIVKYQPGINEAAKAMLRELSKLDSSPRLENFSNSPESFLIGDGSPQSNASSGRVSGVTLQEVPPTSGKPLLNTASAIAGQSLLPATSEMQSSHLGTCSEIINNQLSNIIPLVGGEDLHPGSLSASDMIMPELSQLQGILPENNTDVIGCDSFMDTIAVEGKMGLDIGSLSPGADIDWQSGLLDEIQEFPSVGDPFWEKFLQSPSSPDAAMDDDISNTSETKPQINGWDKTQNMEHLTEQMGATNIKQQKHMI

SEQ ID NO: 323 - protein, 527 aa, Solanum lycopersicum
  misc_feature: Public GI ID no.11386827
  misc_feature: Bit score of 1432.5 for HMM based on sequences of FIGURE 12.
  misc_feature (38)..(223): Pfam Name: HSF_DNA-bind Pfam Description: HSF-type DNA-binding
  misc_feature: Functional Homolog Of Ceres LOCUS ID no. At1g32330 at SEQ ID NO. 311
MEPNSYGSGKAAVGDGVGAPMLQTAPAPAPIPSANAPPPFLVKTYDMVDDPSTDKIVSWSPTNNSFVVWDPPEFAKDLLPKYFKHNNFSSFVRQLNTYGFRKVDPDRWEFANEGFLRGQKHLLKSISRRKPAHGHAQQQQQPHGNAQQQMQPPGHSASVGACVEVGKFGLEEEVERLKRDKNVLMQELVRLRQQQQATDNQLQGMVQRLQGMELRQQQMMSFLAKAVNRPGFLAQFVQQQNESNKRIAEGSKKRRIKQDIESQDPSVTPADGQIVKYQPGINEAAKAMLRELSKLDSSPRLDNFSNSPESFLIGDGSPQSNASSGRVSGVTLQEVPPTSGKPLLNTASAIAGQSLLPATSEMQSSHLGTCSEIINNQLSNIIPLVGGEDLHPGSLSASDMIMPELSQLQGILPENNTDVIGCDSFMDTSAVEGKVGLDIIGSCLSPGADIDWQSGLLDEIEEFPSVGDPFWEKFLQSPCSPDAAMDDDISNTSETKPQINGWDKTQNMEHLTEQMGATNIKQQKHMI

SEQ ID NO: 324 - DNA, 1815 bp, Gossypium hirsutum
  misc_feature: Ceres CLONE ID no.1919643
  misc_feature: Encodes the peptide sequence at SEQ ID NO 325
cttagcttttactctttcaaatcttagctcttcccatggcaaattcgctcactcgctgatcttcaaatccatatttattttcttcgaaaaccctttttcttgttttttcttatcactaaaatcccgaaatggattctcttcatgattcaatatcagcggcgaacgcggcggccgctgccaacggcaacaccgtgccgccgtttctcagcaaaacctacgatgtggtgaatgacccatcgaccgactccgtcgtgtcgtggagtagcggtaataacagttttgttgtctggaaagtgccggagtttgcaagggatcttttgcccaagtattttaagcacaataacttctccagctttgtcaggcagctcaatacatatggttttagaaaagttgaccctgaccgctgggaattttctaatgaggggttcctacgaggtcagaaacatctattgaaaactatcagcaggcggaaacctcctaatgtccagagtaatcagcaacctcaagttcagaactcatctgttggagcttgcattgaggtcgggaagtttggtattgaagaggaggttgaaagacttaagagggacaagaatgttctcatgcaggaacttgttaggttgaggcagcagcagcaaacaacggataaccagttgcaaactgttggccagcgtgtacaggtgatggagcagaggcagcagcaaatgatgtcttttcttgccaaggctatgcaaagtccgagtttcttaggccagcttgtgcagcagcaaaatgaaagcaacaggcgcattactggagcaaacaagaagaggagactccccaggcaggatgaagaaaatttagctggtgaaaatggtgccgtatctgctaaagggcagattgtaaagtttcagccttcactgaatggggcagcgaaggcgatgctgcaccagataatgaagatgaatacatcacctagtttggacccttcgataaataattcgggttcattcttgattgatggtgttcctccttccaatgcaccggacagcaggagctcgtccagtcggatttcaggtgtgacactttcagaagtccaaccagcttctgcgcaatcttatctgcaagcggaatcaggttttcctgacacttgtctgtcagctgccgctcatttaacatccgagcatactaatgtggatcaaatttctcggataaatgagcataagtctcagaaacatggagttattccaaatgtttctcaaatgcaaggaactatgcctgatagcacagttggacttactgacagaagtttggcaggatctgagagaggcaatgcggagtatcttgatccactgttagacgttttggatggtacaatgcccgtagaaactgatgatttttctgccgatcatgatatggacatcttactcgatggatctcctgaacttccagcaattaatgacgttttttgggagaagtttcttgcaacaagccctctaaccggggacaccgatgaaattagttcaagctcacttgaaaatggtgcaaacctggaacaacagcaagcaccggtgaggcaagagaacggatgggatggaattcatcatatgaaccatcttaccgagcaaatgggccttctttcatcaaatggacagatcagaggttgatgatgatctatgatgcggtcaagaaaagctttttaattcaaagagaaatggtttgttgttgaaaggggttatttttggtgttactacatgtaccaataacataaatgcattggaaatggttatccaaatacatatgtatgatgtttctcgacaaaaaaaaaaaaaaaaaaaa

SEQ ID NO: 325 - protein, 504 aa, Gossypium hirsutum
  misc_feature: Ceres CLONE ID no.1919643
  misc_feature: Bit score of 812.8 for HMM based on sequences of FIGURE 12.
  misc_feature (23)..(196): Pfam Name: HSF_DNA-bind Pfam Description: HSF-type DNA-binding
  misc_feature: Functional Homolog Of Ceres LOCUS ID no. At1g32330 at SEQ ID NO. 311
MDSLHDSISAANAAAAANGNTVPPFLSKTYDVVNDPSTDSVVSWSSGNNSFVVWKVPEFARDLLPKYFKHNNFSSFVRQLNTYGFRKVDPDRWEFSNEGFLRGQKHLLKTISRRKPPNVQSNQQPQVQNSSVGACIEVGKFGIEEEVERLKRDKNVLMQELVRLRQQQQTTDNQLQTVGQRVQVMEQRQQQMMSFLAKAMQSPSFLGQLVQQQNESNRRITGANKKRRLPRQDEENLAGENGAVSAKGQIVKFQPSLNGAAKAMLHQIMKMNTSPSLDPSINNSGSFLIDGVPPSNAPDSRSSSSRISGVTLSEVQPASAQSYLQAESGFPDTCLSAAAHLTSEHTNVDQISRINEHKSQKHGVIPNVSQMQGTMPDSTVGLTDRSLAGSERGNAEYLDPLLDVLDGTMPVETDDFSADHDMDILLDGSPELPAINDVFWEKFLATSPLTGDTDEISSSSLENGANLEQQQAPVRQENGWDGIHHMNHLTEQMGLLSSNGQIRG

SEQ ID NO: 326 - protein, 506 aa, Oryza sativa subsp. japonica
  misc_feature: Public GI ID no.115456675
  misc_feature: Bit score of 1316.1 for HMM based on sequences of FIGURE 12.
  misc_feature (36)..(210): Pfam Name: HSF_DNA-bind Pfam Description: HSF-type DNA-binding
  misc_feature: Functional Homolog Of Ceres LOCUS ID no. At1g32330 at SEQ ID NO. 311
MEAAVAAAAAAAGAVTTAVAPPPGAAVSNGVATAPPPFLMKTYEMVDDPATDAVVSWGPGNNSFVVWNTPEFARDLLPKYFKHSNFSSFVRQLNTYGFRKVDPDRWEFANEGFLRGQKHLLKTINRRKPTHGNNQVQQPQLPAAPVPACVEVGKFGMEEEIEMLKRDKNVLMQELVRLRQQQQTTDHQLQTLGKRLQGMEQRQQQMMSFLAKAMHSPGFLAQFVQQNENSRRRIVASNKKRRLPKQDGSLDSESASLDGQIVKYQPMINEAAKAMLRKILKLDSSHRFESMGNSDNFLLENYMPNGQGLDSSSSTRNSGVTLAEVPANSGLPYVATSSGLSAICSTSTPQIQCPVVLDNGIPKEVPNMSAVPSVPKAVAPGPTDINILEFPDLQDIVAEENVDIPGGGFEMPGPEGVFSLPEEGDDSVPIETDEILYNDDTQKLPAIIDSFWEQFLVASPLSVDNDEVDSGVLDQKETQQGNGWTKAENMANLTEQMGLLSSHHTG

SEQ ID NO: 327 - protein, 483 aa, Arabidopsis thaliana
  misc_feature: Public GI ID no.429155
  misc_feature: Bit score of 943.9 for HMM based on sequences of FIGURE 12.
  misc_feature (51)..(234): Pfam Name: HSF_DNA-bind Pfam Description: HSF-type DNA-binding
  misc_feature: Functional Homolog Of Ceres LOCUS ID no. At1g32330 at SEQ ID NO. 311
MFVNFKYFSFFIRTKMDGVTGGGTNIGEAVTAPPPRNPHPATLLNANSLPPPFLSKTYDMVEDPATDAIVSWSPTNNSFIVWDPPEFSRDLLPKYFKHNNFSSFVRQLNTYGFRKVDPDRWEFANEGFLRGQKHLLKKISRRKSVQGHGSSSSNPQSQQLSQGQGSMAALSSCVEVGKFGLEEEVEQLKRDKNVLMQELVKLRQQQQTTDNKLQVMVKHLQVMEQRQQQIMSFLAKAVQNPTFLSQFIQKQTDSNMHVTEANKKRRLREDSTAATESNSHSHSLDASDGQIVKYQPLRNDSMMWNMMKTDDKYPFLDGFSSPNQVSGVTLQEVLPTTSGQSQAYASVPSGQPLSYLPSTSTSLPDTIMPETSQIPQLTRESINDFPTENYMDTEKNVPEAFISPSPFLDGGSVPIQLEGIPEDPEIDELMSNFEFLEEYMPESPVFGDATTLENNNNNNNNTNGRHMDKLIEELGLLTSETEH

SEQ ID NO: 328 - DNA, 1731 bp, Arabidopsis thaliana
  misc_feature: Ceres CLONE ID no.1194199
  misc_feature: Encodes the peptide sequence at SEQ ID NO 329
gatgtttgtaaatttcaaatacttctctttctttatccgtacgaaaatggacggtgttaccggcggaggaacgaatatcggcgaggctgtgacggcgccaccaccgcggaatccgcatccagcgactttacttaatgcgaactctttaccgccccctttccttagcaagacgtatgacatggtggaagatccggcgacggacgcgattgtctcatggagtccgacgaacaatagcttcattgtttgggatccaccggagttttctcgtgatcttctacctaaatacttcaaacacaacaatttctccagctttgttcgccagttaaacacctatggttttaggaaagtggatccagatcgatgggaatttgctaatgaaggtttcttaagaggtcaaaaacatctattgaagaagataagccggagaaaatctgttcagggacatggtagtagtagtagtaatccacaatctcagcaattatctcagggtcaaggttcaatggctgcattatcttcatgtgttgaggttgggaaatttgggttagaggaagaagttgaacagcttaaaagagacaaaaacgtgttgatgcaggaactcgttaagttacgccagcagcaacaaacaacagataataaacttcaggttatggttaaacatcttcaggttatggagcagaggcaacaacagattatgtctttccttgctaaagctgtacagaatcctactttcctctctcagtttatacagaagcagactgatagtaatatgcatgtaaccgaggccaataagaagcggagactcagagaggatagtactgctgctactgagagtaatagtcatagccatagcttggatgcatcagatggacagatagttaagtatcagccacttagaaacgattcaatgatgtggaacatgatgaaaacagatgataagtatccgtttcttgacgggttctcatctccaaaccaggtatcaggagtcactcttcaagaggtactacccacaacttcaggacagtcacaggcatatgcatctgtaccatcaggacagcctttatcatacttaccctctacttcaacttctctcccggataccataatgccagagacttcccagataccacaattgacacgagggagtatcaacgacttccctacagaaaactacatggatacagagaagaatgttccagaggcattcatctctccaagcccattccttgatggtggttcagtcccgattcagcttgagggaatacccgaagaccccgagattgatgaactaatgagtaactttgaattccttgaagaatatatgccagaaagcccagtttttggagatgcaactacactagagaacaacaacaacaacaacaacaacaacaacaacaacaacaacaacacaaatggtagacatatggataagcttatagaagaattgggtcttctcacatcagaaacagaacactagtaaaggattatgtttagtatccattgtaaagtctttctctactaacattatcgttaggactcagtagtacggttgcaactttgtgcagaaatctttccattggataatagaagagttgtatttattattaaaaagaaaatgccattttttctaatttattgtagaaagtgactactttgtccaatcatatttgtagtcctttttcgataagaaaaacagagttggaattttcccgaaaaaaaaaaaaaaaaaaaaaa

SEQ ID NO: 329 - protein, 490 aa, Arabidopsis thaliana
  misc_feature: Ceres CLONE ID no.1194199
  misc_feature: Bit score of 945.5 for HMM based on sequences of FIGURE 12.
  misc_feature (51)..(234): Pfam Name: HSF_DNA-bind Pfam Description: HSF-type DNA-binding
  misc_feature: Functional Homolog Of Ceres LOCUS ID no. At1g32330 at SEQ ID NO. 311
MFVNFKYFSFFIRTKMDGVTGGGTNIGEAVTAPPPRNPHPATLLNANSLPPPFLSKTYDMVEDPATDAIVSWSPTNNSFIVWDPPEFSRDLLPKYFKHNNFSSFVRQLNTYGFRKVDPDRWEFANEGFLRGQKHLLKKISRRKSVQGHGSSSSNPQSQQLSQGQGSMAALSSCVEVGKFGLEEEVEQLKRDKNVLMQELVKLRQQQQTTDNKLQVMVKHLQVMEQRQQQIMSFLAKAVQNPTFLSQFIQKQTDSNMHVTEANKKRRLREDSTAATESNSHSHSLDASDGQIVKYQPLRNDSMMWNMMKTDDKYPFLDGFSSPNQVSGVTLQEVLPTTSGQSQAYASVPSGQPLSYLPSTSTSLPDTIMPETSQIPQLTRGSINDFPTENYMDTEKNVPEAFISPSPFLDGGSVPIQLEGIPEDPEIDELMSNFEFLEEYMPESPVFGDATTLENNNNNNNNNNNNNNNTNGRHMDKLIEELGLLTSETEH

SEQ ID NO: 330 - protein, 495 aa, Arabidopsis thaliana
  misc_feature: Public GI ID no.15236631
  misc_feature: Bit score of 930.1 for HMM based on sequences of FIGURE 12.
  misc_feature (51)..(234): Pfam Name: HSF_DNA-bind Pfam Description: HSF-type DNA-binding
  misc_feature: Functional Homolog Of Ceres LOCUS ID no. At1g32330 at SEQ ID NO. 311
MFVNFKYFSFFIRTKMDGVTGGGTNIGEAVTAPPPRNPHPATLLNANSLPPPFLSKTYDMVEDPATDAIVSWSPTNNSFIVWDPPEFSRDLLPKYFKHNNFSSFVRQLNTYGFRKVDPDRWEFANEGFLRGQKHLLKKISRRKSVQGHGSSSSNPQSQQLSQGQGSMAALSSCVEVGKFGLEEEVEQLKRDKNVLMQELVKLRQQQQTTDNKLQVLVKHLQVMEQRQQQIMSFLAKAVQNPTFLSQFIQKQTDSNMHVTEANKKRRLREDSTAATESNSHSHSLEASDGQIVKYQPLRNDSMMWNMMKTDDKYPFLDGFSSPNQVSGVTLQEVLPITSGQSQAYASVPSGQPLSYLPSTSTSLPDTIMPETSQIPQLTRESINDFPTENFMDTEKNVPEAFISPSPFLDGGSVPIQLEGIPEDPEIDELMSNFEFLEEYMPESPVFGDATTLENNNNNNNNNNNNNNNNNNNNTNGRHMDKLIEELGLLTSETEH

SEQ ID NO: 331 - DNA, 1491 bp, Populus balsamifera subsp. trichocarpa
  misc_feature: Ceres ANNOT ID no.1523420
  misc_feature: Encodes the peptide sequence at SEQ ID NO 332
atggatagtgggaataataacacgaacacggtgcctccatttctaagcaagacctacgacatggtagacgacccgtcgacggattcagtggtgtcatggagtagcagcaataacagttttgtggtctggaatgtcccagagtttcaaacagatcttttgcctaaatacttcaagcacagtaacttctccagctttgtcaggcaattgaatacttacggtttcaggaaggttgatcctgatcgctttgaatttgcaaatgaggggttcttaaggggccaaaaacaccttctgaggagtatatctaggaaaaaacctgttcatggtaacctaccacctcaagttcagagctcttcggttaccacatgcgttgaggttgggaagtttgggctcgaggaagaggttgaaagacttaaacgagacaaaaatgttctcatgcaggaacttgttagactgaggcagcagcagcaagccacagatcaccagttgcacactgtgggccaacgtgtacagggaatggagcagcgacagcaacaaatgatgtcattccttgcgaaggccatgcagaatccaggcttcttaagtcagcttgtacagcagcaaaatgaaagcaacagacgcattgctggtgccagtaaaaagaggagacttccaaggcaggaggaagagaatttggctggtgtgcaatgcaaaacatctcctaatgggcagattatcaagttccattcttcaatgaatgaagcagcaaaagcaatgttgcaccagatcctgaagatgaactcatcacctaggctggaaccatcgatgaacaattctggtcccttactgatcggtaatcatccttcttccaatggattagacagtgggagctcttcaactcggatgtcaggagtgatgctttcagaggttccaacagcttctgggccatcatatttgcctatggaaactgggttcccagccagccattcaactactgccatttctgaggtccaatctcctgcttctgtagcaaccgactatgttaaaacagattatactgctgagatgggcatgcataattctgggcaaaataccatcctgcccaacttcactgcaatgacaggaattgtgcccggaggctctgctggaggtcctaacatgaatattgcagggtctgagaaggggaatgcagagttttttgacaccatgtcatctgtgttggatgcgccagtgcccatagaaactgaagctctctctcccagccaggatgaggaagtctttctggatggaaaccataagcttcctggcattaatgatgtgttctgggaacaatttcttacagcaagcccgctcaatggggagacagatgaaattaattcaagctctccagaaagtagcatgagcaaggagcaggaattgcaatcatggcaggacaatggatgggacaatattcaacatatgaatcgtctagctgaacaaatggggcttcttacaccggaaagcttaaaagggtga

SEQ ID NO: 332 - protein, 496 aa, Populus balsamifera subsp. trichocarpa
  misc_feature: Ceres ANNOT ID no.1523420
  misc_feature: Bit score of 760.2 for HMM based on sequences of FIGURE 12.
  misc_feature (12)..(183): Pfam Name: HSF_DNA-bind Pfam Description: HSF-type DNA-binding
  misc_feature: Functional Homolog Of Ceres LOCUS ID no. At1g32330 at SEQ ID NO. 311
MDSGNNNTNTVPPFLSKTYDMVDDPSTDSVVSWSSSNNSFVVWNVPEFQTDLLPKYFKHSNFSSFVRQLNTYGFRKVDPDRFEFANEGFLRGQKHLLRSISRKKPVHGNLPPQVQSSSVTTCVEVGKFGLEEEVERLKRDKNVLMQELVRLRQQQQATDHQLHTVGQRVQGMEQRQQQMMSFLAKAMQNPGFLSQLVQQQNESNRRIAGASKKRRLPRQEEENLAGVQCKTSPNGQIIKFHSSMNEAAKAMLHQILKMNSSPRLEPSMNNSGPLLIGNHPSSNGLDSGSSSTRMSGVMLSEVPTASGPSYLPMETGFPASHSTTAISEVQSPASVATDYVKTDYTAEMGMHNSGQNTILPNFTAMTGIVPGGSAGGPNMNIAGSEKGNAEFFDTMSSVLDAPVPIETEALSPSQDEEVFLDGNHKLPGINDVFWEQFLTASPLNGETDEINSSSPESSMSKEQELQSWQDNGWDNIQHMNRLAEQMGLLTPESLKG

SEQ ID NO: 333 - DNA, 1734 bp, Populus balsamifera subsp. trichocarpa
  misc_feature: Ceres ANNOT ID no.1447046
  misc_feature: Encodes the peptide sequence at SEQ ID NO 334
atggatggaacaatcaactctgcaagcggtggcgactcctcgatcagcggcggtggggcacaagcggcgtcggtgccgatggcgtcacagtcgaatgcgccgccgccatttctaagtaagacttacgacatggtagacgatccggcgacagacgcggtggtgtcttggagttcgacgaataatagttttgtggtttggaatccgccggagttcgctcgcgatcttttgccgaattttcttgctttacttctagctgtatgtggaaggaactcgacaagagcttatcctttcaccttcaatattgcctcaaggaaattatgtgctccttttaaatcaaacggaaatgcagttggctttctcagaaagcaagtgggcatcgaactcccaatcatagctgaaatgtctttaccacgagctagtgttcatcttgcctcttgtggccacatcatctccctcaaacctttggcactaacaatatctgcattcctacccttgggttttcgaaaggtggatccagaccgttgggaatttgccaatgaaggatttttgaggggtcagaagcacctgcttaggattatcagtcggcgaaaacctgcccacgggcatgctaatcaacagccacaacaaccgcatggacagaactcatcagttgccgcctgtgttgaggttgggaaatttgggctcgaggaagaggtggagaggcttaagagggacaagaatgtccttatgcaagaacttgttaggttgaggcagcagcaacagtccacagatagccagttgcaaaccatggtacagcgacttcaaggaatggagcagcgtcagcaacagatgatgtcattcctggccaaggcgatgaacagcccaggcttcttggctcagtttgtacagcagcaaaatgacaacaataggcgcataacggaagccaataaaaaacgaaggctcaagcaggaggatgttcctgagaatgagggttctggttctcatgatgggcagattgtgaagtatcagcctctgatgaatgaggcagcccaagcaatgcttaggcagattatgaaaatggatgcttcttctaagttggaatcttatgacaataatcttggtgcaaaagacagtggaagctcttcgagccacacatcaggagtgactcttcaagaggttctgccaacttcagggcaatccgctcatataccagcagcttttgggatttccaggcagggcccatcggctccaatatctgaaatacaatcttccctgcaaattgctagttctgaaaaggttacagcttctcagtttccggatataagtatgccggttggagcacagggggcaacctccatacctattcctcaggcagatgtgatcatgccccatgtttctcaaatgcttgaaatggtaccagaaaatgttgctgatatcccttgtgaagattacatggaaccagagacatgcaatgatggattcatagatctagcttcattaggaattaatggaatacccatagatattgataacatttcccctgatcctgatattgatgctttgcttgataattctagcttctgggatgaccttcttgtgcagagtccagagcatgaggatattgaatcaagttctgtagagggtaaagccaatggaaatgatgtgcagccaaatgcaaacgggtgggacaaagctcagcatgtggatcagctgacagaacaaatggagcttctgacatcagacaagaagctttaa

SEQ ID NO: 334 - protein, 577 aa, Populus balsamifera subsp. trichocarpa
  misc_feature: Ceres ANNOT ID no.1447046
  misc_feature: Bit score of 1040.1 for HMM based on sequences of FIGURE 12.
  misc_feature (35)..(281): Pfam Name: HSF_DNA-bind Pfam Description: HSF-type DNA-binding
  misc_feature: Functional Homolog Of Ceres LOCUS ID no. At1g32330 at SEQ ID NO. 311
MDGTINSASGGDSSISGGGAQAASVPMASQSNAPPPFLSKTYDMVDDPATDAVVSWSSTNNSFVVWNPPEFARDLLPNFLALLLAVCGRNSTRAYPFTFNIASRKLCAPFKSNGNAVGFLRKQVGIELPIIAEMSLPRASVHLASCGHIISLKPLALTISAFLPLGFRKVDPDRWEFANEGFLRGQKHLLRIISRRKPAHGHANQQPQQPHGQNSSVAACVEVGKFGLEEEVERLKRDKNVLMQELVRLRQQQQSTDSQLQTMVQRLQGMEQRQQQMMSFLAKAMNSPGFLAQFVQQQNDNNRRITEANKKRRLKQEDVPENEGSGSHDGQIVKYQPLMNEAAQAMLRQIMKMDASSKLESYDNNLGAKDSGSSSSHTSGVTLQEVLPTSGQSAHIPAAFGISRQGPSAPISEIQSSLQIASSEKVTASQFPDISMPVGAQGATSIPIPQADVIMPHVSQMLEMVPENVADIPCEDYMEPETCNDGFIDLASLGINGIPIDIDNISPDPDIDALLDNSSFWDDLLVQSPEHEDIESSSVEGKANGNDVQPNANGWDKAQHVDQLTEQMELLTSDKKL

SEQ ID NO: 335 - protein, 432 aa, Brassica oleracea
  misc_feature: Public GI ID no.89274218
  misc_feature: Bit score of 1082.0 for HMM based on sequences of FIGURE 12.
  misc_feature (36)..(215): Pfam Name: HSF_DNA-bind Pfam Description: HSF-type DNA-binding
  misc_feature: Functional Homolog Of Ceres LOCUS ID no. At1g32330 at SEQ ID NO. 311
MDGVTGGDSKSGEATTAPPLRNPHPATLLGTNALPPPFLSKTYDMVEDPASDAIVSWSPANNSFVVWDPPEFSRSLLPRYFKHNNFSSFVRQLNTYGFRKVDPDRWEFANEGFLRGQKHLLKTISRRKSTQGHGSSSSSNPQSHQGHMASLSSCVEVGKFGLEEEVEQLKRDKNVLMQELVKLRQQQQSTDSKLQSMVKSLQTMEQRQQQIMSFLAKAVQNPTFLSQFIQKQTDSGNMHVTEASKKRRLTEDAAAASDGQIVKYQPIRSDSTMSMMWNMMNTDEKFPFSPNRDSGVTFQEVLLPTTSGQSQAYAPISSASTSLMPMIPPMPQESISDSPTENYMNAEKDVSEAFISPSPFLDGGSVPNQLEGLPQDLDIDELMSNCDIFEEYLAQSPVFGDETTLESSDANGGHVDKLIEELGHLTSETKQL

SEQ ID NO: 336 - protein, 481 aa, Arabidopsis thaliana
  misc_feature: Public GI ID no.25296101
  misc_feature: Bit score of 671.7 for HMM based on sequences of FIGURE 12.
  misc_feature (26)..(200): Pfam Name: HSF_DNA-bind Pfam Description: HSF-type DNA-binding
  misc_feature: Functional Homolog Of Ceres LOCUS ID no. At1g32330 at SEQ ID NO. 311
MESVPESVPSPNSNTPSIPPPVNSVPPFLSKTYDMVDDPLTNEVVSWSSGNNSFVVWSAPEFSKVLLPKYFKHNNFSSFVRQLNTYGFRKVDPDRWEFANEGFLRGRKQLLKSIVRRKPSHVQQNQQQTQVQSSSVGACVEVGKFGIEEEVERLKRDKNVLMQELVRLRQQQQATENQLQNVGQKVQVMEQRQQQMMSFLAKAVQSPGFLNQLVQQNNNDGNRQIPGSNKKRRLPVDEQENRGDNVANGLNRQIVRYQPSINEAAQNMLRQFLNTSTSPRYESVSNNPDSFLLGDVPSSTSVDNGNPSSRVSGVTLAEFSPNTVQSATNQVPEASLAHHPQAGLVQPNIGQSPAQGAAPADSWSPEFDLVGCETDSGECFDPIMAVLDESEGDAISPEGEGKMNELLEGVPKLPGIQDPFWEQFFSVELPAIADTDDILSGSVENNDLVLEQEPNEWTRNEQQMKYLTEQMGLLSSEAQRK

SEQ ID NO: 337 - protein, 468 aa, Arabidopsis thaliana
  misc_feature: Public GI ID no.15228440
  misc_feature: Bit score of 596.6 for HMM based on sequences of FIGURE 12.
  misc_feature (22)..(195): Pfam Name: HSF_DNA-bind Pfam Description: HSF-type DNA-binding
  misc_feature: Functional Homolog Of Ceres LOCUS ID no. At1g32330 at SEQ ID NO. 311
MGTVCESVATAKSSTAVMSSIPPFLSKTYDMVDDPLTDDVVSWSSGNNSFVVWNVPEFAKQFLPKYFKHNNFSSFVRQLNTYGFRKVDPDRWEFANEGFLRGQKQILKSIVRRKPAQVQPPQQPQVQHSSVGACVEVGKFGLEEEVERLQRDKNVLMQELVRLRQQQQVTEHHLQNVGQKVHVMEQRQQQMMSFLAKAVQSPGFLNQFSQQSNEANQHISESNKKRRLPVEDQMNSGSHGVNGLSRQIVRYQSSMNDATNTMLQQIQQMSNAPSHESLSSNNGSFLLGDVPNSNISDNGSSSNGSPEVTLADVSSIPAGFYPAMKYHEPCETNQVMETNLPFSQGDLLPPTQGAAASGSSSSDLVGCETDNGECLDPIMAVLDGALELEADTLNELLPEVQDSFWEQFIGESPVIGETDELISGSVENELILEQLELQSTLSNVWSKNQQMNHLTEQMGLLTSDALRK

SEQ ID NO: 338 - protein, 468 aa, Arabidopsis thaliana
  misc_feature: Public GI ID no.6624612
  misc_feature: Bit score of 589.3 for HMM based on sequences of FIGURE 12.
  misc_feature (22)..(195): Pfam Name: HSF_DNA-bind Pfam Description: HSF-type DNA-binding
  misc_feature: Functional Homolog Of Ceres LOCUS ID no. At1g32330 at SEQ ID NO. 311
MGTVCESVATAKSSTAVMSSIPPFLSKTYDMVDDPLTDDVVSWSSGNNSFVVWNVPEFAKQFLPKYFNHNNFSSFVRQLNTYGFRKVDPDRWEFANEGFLRGQKQILKSIVRRKPAQVQPPQQPQVQHSSVGACVEVGKFGLEEEVERLQRDKNVLMQELVRLRQQQQVTEHHLQNVGQKVHVMEQRQQQMMSFLAKAVQSPGFLNQFSQQSNEANQHISESNKKRRLPVEDQMNSGSHGVNGLSRQIVRYQSSMNDATNTMLQQIQQMSNAPSHESLSSNNGSFLLGDVPNSNISDNGSSSNGSPEVTLADVSSIPAGFYPAMKYHEPCETNQVMETNLPFSQGDLLPPTQGAAASGSSSSDLVGCETDNGECLDPIMAVLDGALELEADTLNELLPEVQDSFWEQFIGESPVIGETDELISGSVENELILEQLELQSTLSNVWSKNQQMNHLTEQMGLLTSDALRK

SEQ ID NO: 339 - protein, 489 aa, Oryza sativa subsp. japonica
  misc_feature: Public GI ID no.125588688
  misc_feature: Bit score of 1107.2 for HMM based on sequences of FIGURE 12.
  misc_feature (36)..(193): Pfam Name: HSF_DNA-bind Pfam Description: HSF-type DNA-binding
  misc_feature: Functional Homolog Of Ceres LOCUS ID no. At1g32330 at SEQ ID NO. 311
MEAAVAAAAAAAGAVTTAVAPPPGAAVSNGVATAPPPFLMKTYEMVDDPATDAVVSWGPGNQKLRCVKQPRVRARPPPQGFRKVDPDRWEFANEGFLRGQKHLLKTINRRKPTHGNNQVQQPQLPAAPVPACVEVGKFGMEEEIEMLKRDKNVLMQELVRLRQQQQTTDHQLQTLGKRLQGMEQRQQQMMSFLAKAMHSPGFLAQFVQQNENSRRRIVASNKKRRLPKQDGSLDSESASLDGQIVKYQPMINEAAKAMLRKILKLDSSHRFESMGNSDNFLLENYMPNGQGLDSSSSTRNSGVTLAEVPANSGLPYVATSSGLSAICSTSTPQIQCPVVLDNGIPKEVPNMSAVPSVPKAVAPGPTDINILEFPDLQDIVAEENVDIPGGGFEMPGPEGVFSLPEEGDDSVPIETDEILYNDDTQKLPAIIDSFWEQFLVASPLSVDNDEVDSGVLDQKETQQGNGWTKAENMANLTEQMGLLSSHHTG

SEQ ID NO: 340 - protein, 372 aa, Oryza sativa subsp. japonica
  misc_feature: Public GI ID no.115470859
  misc_feature: Bit score of 203.9 for HMM based on sequences of FIGURE 12.
  misc_feature (51)..(219): Pfam Name: HSF_DNA-bind Pfam Description: HSF-type DNA-binding
  misc_feature: Functional Homolog Of Ceres LOCUS ID no. At1g32330 at SEQ ID NO. 311
MDDPMLNAVKEEESHGDGGGLEVVAGEDGAAAVAAGVAPRPMEGLHDAGPPPFLTKTYDMVDDAGTDAAVSWSATSNSFVVWDPHAFATVLLPRFFKHNNFSSFVRQLNTYGFRKVDPDRWEFANENFLRGQRHLLKNIKRRKPPSHTASNQQSLGPYLEVGHFGYDAEIDRLKRDKQLLMAEVVKLRQEQQNTKANLKAMEDRLQGTEQRQQQMMAFLARVMKNPEFLKQLMSQNEMRKELQDAISKKRRRRIDQGPEVDDVGTSSSIEQESPALFDPQESVEFLIDGIPSDLENSAMDAGGLVEPQDFDVGASEQQQIGPQGELNDNFWEELLNEGLVGEENDNPVVEDDMNVLSEKMGYLNSNGPTAGE

SEQ ID NO: 341 - protein, 406 aa, Arabidopsis thaliana
  misc_feature: Public GI ID no.15228865
  misc_feature: Bit score of 178.3 for HMM based on sequences of FIGURE 12.
  misc_feature (60)..(236): Pfam Name: HSF_DNA-bind Pfam Description: HSF-type DNA-binding
  misc_feature: Functional Homolog Of Ceres LOCUS ID no. At1g32330 at SEQ ID NO. 311
MDPSFRFIKEEFPAGFSDSPSPPSSSSYLYSSSMAEAAINDPTTLSYPQPLEGLHESGPPPFLTKTYDLVEDSRTNHVVSWSKSNNSFIVWDPQAFSVTLLPRFFKHNNFSSFVRQLNTYGFRKVNPDRWEFANEGFLRGQKHLLKNIRRRKTSNNSNQMQQPQSSEQQSLDNFCIEVGRYGLDGEMDSLRRDKQVLMMELVRLRQQQQSTKMYLTLIEEKLKKTESKQKQMMSFLARAMQNPDFIQQLVEQKEKRKEIEEAISKKRQRPIDQGKRNVEDYGDESGYGNDVAASSSALIGMSQEYTYGNMSEFEMSELDKLAMHIQGLGDNSSAREEVLNVEKGNDEEEVEDQQQGYHKENNEIYGEGFWEDLLNEGQNFDFEGDQENVDVLIQQLGYLGSSSHTN

SEQ ID NO: 342 - DNA, 1960 bp, Zea mays
  misc_feature: Ceres CLONE ID no.1571069
  misc_feature: Encodes the peptide sequence at SEQ ID NO 343
acccgcgctcgtgacggctcacccacccccgccgtggttccgggcaacagggaagaagatcccgccctggtgccaccacgaggcacccggcggctttgatttcctctccgcccctggcgtctggcgtggtgctctggcccccagtttgtcggctgctttctacctgtacttgcagagctgtaggtgggggtaaacatggtgaggtggtcttgccaggatgacaccttatcatgttccctatccccgtgctagatgcgcgccggccgccgtgtgtgtgtatgccttaacgtcgatgcgtgccttgtactcctgtgtggccgtgtgctaggggcagctgctcgttgctgctcttttacaacggagttttactgacattgtccaacagactattccattccggtgtcagagcagagattttagcatcgttactcggattaggagggtaggatccggctatggactcaacgctgaaccaggtgaaggaggagagccatggggagggaggagatttgatggcaggcacggtggaggccgcggatgggccgtccgcggccgtcgccgcggcaccaaagccgatggagggtctgcatgaccctgggccgccgccgttcctcaccaagacatatgacatggtcgacgactcggacaccgacctgattgtgtcttggagcgccaccaacaacagcttcgtggtgtgggatccgcacgccttcgccacggtgctgctgcccaggcacttcaagcacaacaacttctccagcttcgtccggcagctcaacacctatggtttcaggaaggtggatcctgatcggtgggaattcgcgaatgagggctttttacggggacagagacacctcctgaagaacatcaggcgtcgaaaacctcctgctcagaatgccacaaaccagcagtccattgggccttaccttgaggtgggacattttggatatgatgcagagattgacatgttgaagagagacaagcagttactgatggcagaagtggtgaagctaaggcaggagcagcagaacacaaaggcaaatctcaaagcgatggaggataggctacaagggactgaacagaagcagcagcagatgatggcgttcttggcacgtgtcatgcggaatcctgaattcttgaagcacctggtttcccagaatgagatgaggaaggagcttcaagatgctatttcaaagaaaagaagacggcgcatcgaccaagggcctgaagctgatgacttgggggctagtagcagcttggagcaaggttcaccggtcctgtttaatgcccaggacccagttgaattccttgtcgacggaatcccagctgacctcgagagcccagctttcgatggccacggcctgattgggccacatgatattgatattgatattgatattggcagtacctctgagcagcagcaagacatgccccaggaggatctgaatgacaacttctgggagcagttgctgaacgaaggacttggcgaggagaacgatagccctgtaatcgaggatgatatgaatgtgctgtctgagaagatgggttatctcaactcagatggcccaacatctagcaattagtcttggcttcgttgctgttttgttatttccatcttaccagaacccgcagctcctgaattgtgttcactgtgtcagcaagactaggcaattctgcttccgttgctcggtttccatgcccttctgaattcctcgccaatggtagggcttgcttccatgagaattggctggcattcgccatggtgtcaagggagaactgctaggtgcatctgatgtgatctgactagtgattgctgcttgccactggagtggctgttttaggcgacgccagcgatctgttggttgttttacgaccctgcccgtcaggaattcagtctgtagttatgtacagtgacagcgactcagcaagtagtactgatggttaaaaaaaaaaaaaaaaa

SEQ ID NO: 343 - protein, 375 aa, Zea mays
  misc_feature: Ceres CLONE ID no.1571069
  misc_feature: Bit score of 222.4 for HMM based on sequences of FIGURE 12.
  misc_feature (50)..(218): Pfam Name: HSF_DNA-bind Pfam Description: HSF-type DNA-binding
  misc_feature: Functional Homolog Of Ceres LOCUS ID no. At1g32330 at SEQ ID NO. 311
MDSTLNQVKEESHGEGGDLMAGTVEAADGPSAAVAAAPKPMEGLHDPGPPPFLTKTYDMVDDSDTDLIVSWSATNNSFVVWDPHAFATVLLPRHFKHNNFSSFVRQLNTYGFRKVDPDRWEFANEGFLRGQRHLLKNIRRRKPPAQNATNQQSIGPYLEVGHFGYDAEIDMLKRDKQLLMAEVVKLRQEQQNTKANLKAMEDRLQGTEQKQQQMMAFLARVMRNPEFLKHLVSQNEMRKELQDAISKKRRRRIDQGPEADDLGASSSLEQGSPVLFNAQDPVEFLVDGIPADLESPAFDGHGLIGPHDIDIDIDIGSTSEQQQDMPQEDLNDNFWEQLLNEGLGEENDSPVIEDDMNVLSEKMGYLNSDGPTSSN

SEQ ID NO: 344 - protein, 357 aa, Oryza sativa subsp. japonica
  misc_feature: Public GI ID no.115455903
  misc_feature: Bit score of 216.8 for HMM based on sequences of FIGURE 12.
  misc_feature (37)..(204): Pfam Name: HSF_DNA-bind Pfam Description: HSF-type DNA-binding
  misc_feature: Functional Homolog Of Ceres LOCUS ID no. At1g32330 at SEQ ID NO. 311
MNYRVVNPVKVESGPSTGVANGQPPRPMDGLADGGPPPFLTKTYDMVDDPTTDAVVSWSATNNSFVVWDPHLFGNVLLPRYFKHNNFSSFVRQLNTYGFRKVDPDKWEFANEGFLRGQKHLLKSIKRRKPPNSSPSQQSLGSFLEVGHFGYEGEIDQLKRDKHLLMAEVVKLRQEQQNTKSDLQAMEQKLQGTEQKQQHMMAFLSRVMHNPEFIRQLFSQSEMRKELEEFVSKKRRRRIDQGPELDSMGTGSSPEQVSQVMFEPHDPVDSLFNGVPSDLESSSVEANGGKAQQDVASSSSEHGKIKPSNGELNEDFWEDLLHEGGLDEDTRNPAIDDMNLLSQKMGYLNSSSTKSPQ

SEQ ID NO: 345 - DNA, 1047 bp, Populus balsamifera subsp. trichocarpa
  misc_feature: Ceres ANNOT ID no.1459422
  misc_feature: Encodes the peptide sequence at SEQ ID NO 346
atggcatctacagctattccacaaccaatggagggactccgtgactcggttcctccaccatttctcaccaaaacttatgatataatagaagatgcaagcacaaaccatattgtttcttggagtagaggtaacaacagctttattatttgggatccccaagccttttccacgagtctcctccctagatacttcaagcacaacaatttctctagctttgttaggcagcttaacacatatgggtttagaaaggttgatccagatagatgggagtttgctaatgaagggtttctcagagggaaaaaacatcttctcaagagtattaggaggagaaaagctcctcaaacactaacttctcaggcttgtgttgaagttggaacatttggactggatggggaagtgaatcgattaaggcgagacaagcaagtactaatggtggaactggtgaagcttagacaacaacaacagactactaaagcttgcattcaacttattgaacgaaaacttaaaaggactgagaataaacagcaacagatgatgagtttcttggctagagcaatgcaaaatcccaactttgtgcagcaactagcccaacaaaaggaaatgaggaaagaacttgaagaggcgattagtaaaaagagaaggcgaccgattgatcaagggcgtagtaattttgaggttgcagaattcggccatggcgagggagtaggaacatttgttaagattgaacatcaggagtttggtgatctttctgagtttgacgatctttctgagtttgacgttccagaatttcacaatccggcaatgaacatgcaaggactaagtgaaaaccaactgatcaacttggtggaagaacgtattgagaaaggagaagaacatggaaataaaggtaacgaaattgatgagggtttctgggaagatttattgaacgaggatattattgacgaagaaatagcagtattgggtagcgaaggtgaagacgaggaagatgtaagcgtgttggttgaacagcttggttacttgggttccagtacagagttgaggacttga

SEQ ID NO: 346 - protein, 348 aa, Populus balsamifera subsp. trichocarpa
  misc_feature: Ceres ANNOT ID no.1459422
  misc_feature: Bit score of 199.1 for HMM based on sequences of FIGURE 12.
  misc_feature (19)..(182): Pfam Name: HSF_DNA-bind Pfam Description: HSF-type DNA-binding
  misc_feature: Functional Homolog Of Ceres LOCUS ID no. At1g32330 at SEQ ID NO. 311
MASTAIPQPMEGLRDSVPPPFLTKTYDIIEDASTNHIVSWSRGNNSFIIWDPQAFSTSLLPRYFKHNNFSSFVRQLNTYGFRKVDPDRWEFANEGFLRGKKHLLKSIRRRKAPQTLTSQACVEVGTFGLDGEVNRLRRDKQVLMVELVKLRQQQQTTKACIQLIERKLKRTENKQQQMMSFLARAMQNPNFVQQLAQQKEMRKELEEAISKKRRRPIDQGRSNFEVAEFGHGEGVGTFVKIEHQEFGDLSEFDDLSEFDVPEFHNPAMNMQGLSENQLINLVEERIEKGEEHGNKGNEIDEGFWEDLLNEDIIDEEIAVLGSEGEDEEDVSVLVEQLGYLGSSTELRT

SEQ ID NO: 347 - DNA, 2345 bp, Zea mays
  misc_feature: Ceres CLONE ID no.1577511
  misc_feature: Encodes the peptide sequence at SEQ ID NO 348
agaggaatccattcccaatttgcgttcccactcccaccaccgcttcttcccgtatcccttgtcctccctaatttcctctcacaaaaagcgggtgcggcgtcctgccactcacctcggtctcggggggcgccgtgcggcgggcgcccgtgctgctggtttcgctccaggggagaaggggcagagggagtagagcaggttaggtccgtttgcgttttcttttgcgggtttgtaggtcaaaagctcggcgagcactttccgctccacctcctcacgctcggaatcaaatcgatgccccccctgatttggttcctggtatcggtgcatgagcttgctccaagagatctcccttttggttcggcgtcaggggttctgtgaggtcacgcggcttcttcctcttggcgctcctcacatgtccgggcgcttcgatctctgcccactgcgcgagtgattctgctgctgcagcagctgttaggtgcgcgcggtccgttatggggtgaaccgaagcgttcctcgcagggctgtgggtttattacgccgcctgtttgcttccccgctccatgtccttgtgcccatgcttctttgcttttgtcacgcctgaaccgtgtcttcttgtagtatctgaggcttggcagttggcaagtacaaactagcaacttgcttaggtataaagtataaaccagtgtctggtgcagagcccaaaggggtcacgaatcgttgatgcatagatctgcttctggctgagataaggctctaagttcgctctgttgatggggctaccatgagccacgggaacgggatgttgaattctgtcaaggtggagaggtggccagcagcagtcgctgcaaatggccagcctaggccgatggatgtgctccacgacggcagctcgccgccgttccttaccaagacgtatgacatggttgatgacccaaccacgaacgccgttgtgtcatggagtgccgccaacaatagctttgtagtttgggatcctcatatctttgggacggtgctgctgccaaggtacttcaagcacaacaacttctccagctttgttcggcagctcaatacttatggcttcagaaaggtggatcctgacagatgggaatttgctaatgaggagtttctgagaggtcagaggcacctcctcaaaaacattaggcgtcggaaacctccacactcatctccaaatcaacaatctcttggctcttacctcgaggtaggacactttggatatgaagaagagattgatcagctgaagagggataaacagctcttgatggctgaggtagtgaagctgaggcaggagcaccaaaatactagatcagatctacaggccatggaagagaaattacaagataccgagcagaagcagcagcagatgatggcattcatggcacgcgtcatgcagaaccctgatttcatgcgtcagctgatctcccagcgggagatgaggaaggagctcgaggatgccatctcgaagaagagaaggcgccgcattgaccagggacatgaagctggtagcatgggcactggttctagcctggagcaagggccacagggagtgtttgaaccgcaggagccggtggaatcactcgccaacggtgtgccatctgatctggagagttcgtctgttgaggcgaagggattggaggttcgacagggtgtttcttcaggtggttctgagcatctgaatggcaggccaagcggagagttaaatgatgatttctgggaggaccttctgcacgaggggggacttggtgcagatgcaggcaatgctgttggtcaggatgatatgaacatggacatggacccagatgttagcctgcctcaactgaaacaacatggacccagacattagccgctcttgtgctatcacaatggctgtgactctgtgagtatctttacagttatgctcgttatacccctgtggtgtacctgtttcgatcgtcttcgaccaaatgtcacgtcgactgcagtctccagttgttaatacagtctgttcagcacgctgatttaagtatttgggtcaagatgttcatataatcctgtggtatccagagatattatagtttgttttcgtaactgtttgcgcagagaccatgctatgttgcctgcaggctatcagtgtatttgttctaacagatcgcaacgctggtacaacgcagtgacctgccagactgggccactatgagattgtagggaaagaccagatagcttgtgtatgtaaaagctgatccatagtagcctatcatgtgcaacgctattgccctttgggatttggcatttcactgtatataacatatcatcgccgtattgccgcatccaaataaaaaaaaaaaaaaaaa

SEQ ID NO: 348 - protein, 359 aa, Zea mays
  misc_feature: Ceres CLONE ID no.1577511
  misc_feature: Bit score of 152.1 for HMM based on sequences of FIGURE 12.
  misc_feature (38)..(205): Pfam Name: HSF_DNA-bind Pfam Description: HSF-type DNA-binding
  misc_feature: Functional Homolog Of Ceres LOCUS ID no. At1g32330 at SEQ ID NO. 311
MSHGNGMLNSVKVERWPAAVAANGQPRPMDVLHDGSSPPFLTKTYDMVDDPTTNAVVSWSAANNSFVVWDPHIFGTVLLPRYFKHNNFSSFVRQLNTYGFRKVDPDRWEFANEEFLRGQRHLLKNIRRRKPPHSSPNQQSLGSYLEVGHFGYEEEIDQLKRDKQLLMAEVVKLRQEHQNTRSDLQAMEEKLQDTEQKQQQMMAFMARVMQNPDFMRQLISQREMRKELEDAISKKRRRRIDQGHEAGSMGTGSSLEQGPQGVFEPQEPVESLANGVPSDLESSSVEAKGLEVRQGVSSGGSEHLNGRPSGELNDDFWEDLLHEGGLGADAGNAVGQDDMNMDMDPDVSLPQLKQHGPRH

SEQ ID NO: 349 - protein, 410 aa, Oryza sativa subsp. japonica
  misc_feature: Public GI ID no.115451657
  misc_feature: Bit score of 130.4 for HMM based on sequences of FIGURE 12.
  misc_feature (49)..(225): Pfam Name: HSF_DNA-bind Pfam Description: HSF-type DNA-binding
  misc_feature: Functional Homolog Of Ceres LOCUS ID no. At1g32330 at SEQ ID NO. 311
MGSKKRSPQHPAAAAPPPAVGGGGGGEVSGDGGASTANGPVVPKPSEVAPFLTKVYDMVSDPATDNVISWAEGGGSFVIWDSHAFERDLHRHFKHSNFTSFIRQLNTYGFRKVHPDRWEWANEGFIMGQKHLLKTIKRRKKSSQESPSEIQKAPVKTAPGTENIEIGKYGGLEKEVETLKRDKALLMQQLVDLRHYQQTSNLEVQNLIERLQVMEQNQQQMMALLAIVVQNPSFLNQLVQQQQQQRRSNWWSPDGSKKRRFHALEQGPVTDQETSGRGAHIVEYLPPVPETSGQVNPVEGAICSANSQPVPSPAVATPMDMQTSNVADTLGSSEEPFADNSTLHEWDDNDMQLLFDDNLDPILPPFENDGQMGPPLSVQDYDFPQLEQDCLMEAQYNSNNPQYADVITEA

SEQ ID NO: 350 - protein, 345 aa, Arabidopsis thaliana
  misc_feature: Public GI ID no.15225255
  misc_feature: Bit score of 152.5 for HMM based on sequences of FIGURE 12.
  misc_feature (43)..(212): Pfam Name: HSF_DNA-bind Pfam Description: HSF-type DNA-binding
  misc_feature: Functional Homolog Of Ceres LOCUS ID no. At1g32330 at SEQ ID NO. 311
MEELKVEMEEETVTFTGSVAASSSVGSSSSPRPMEGLNETGPPPFLTKTYEMVEDPATDTVVSWSNGRNSFVVWDSHKFSTTLLPRYFKHSNFSSFIRQLNTYGFRKIDPDRWEFANEGFLAGQKHLLKNIKRRRNMGLQNVNQQGSGMSCVEVGQYGFDGEVERLKRDHGVLVAEVVRLRQQQHSSKSQVAAMEQRLLVTEKRQQQMMTFLAKALNNPNFVQQFAVMSKEKKSLFGLDVGRKRRLTSTPSLGTMEENLLHDQEFDRMKDDMEMLFAAAIDDEANNSMPTKEEQCLEAMNVMMRDGNLEAALDVKVEDLVGSPLDWDSQDLHDMVDQMGFLGSEP

SEQ ID NO: 351 - protein, 370 aa, Oryza sativa subsp. indica
  misc_feature: Public GI ID no.125545695
  misc_feature: Bit score of 117.3 for HMM based on sequences of FIGURE 12.
  misc_feature (48)..(227): Pfam Name: HSF_DNA-bind Pfam Description: HSF-type DNA-binding
  misc_feature: Functional Homolog Of Ceres LOCUS ID no. At1g32330 at SEQ ID NO. 311
MNPLRVIVKEEELDFAAAAAGEGSPSSWAVGVMDLPRPMEGLGEAGPPPFLCKTYEVVDDPGTDTVISWGFAGNSFVVWDANAFAAVLLPRYFKHSNFSSFVRQLNTYGFRKVDPDRWEFANEGFLRGKKELLKTIKRRRPPPSSPPSSSSSSSSSQHQQQPAAACLEVGQFGRDGVVNRLQRDKSVLIAEVVKLRQEQQTTRAQMQAMEERISAAEQKQQQMTVFLARAMKNPGFLQMLVDRQAGQHGARNRVLEDALSKKRRRPIEYLLTRNGETCAAGESAAMLAADGVAEPDGDTTPRGDGGGGGDTESFWMQLLSLGLEEKQREDGVAGGVQESNSGGADVDNDEEDDDDDVDVLVQSIYHLSPK

SEQ ID NO: 352 - DNA, 1332 bp, Populus balsamifera subsp. trichocarpa
  misc_feature: Ceres ANNOT ID no.1471817
  misc_feature: Encodes the peptide sequence at SEQ ID NO 353
atggatggttcacagagtaacagttcaaatgcaccaccgccttttctaaccaaaacatatgacatggtggatgatcccttgactaactcggtggtgtcatggagccacagtggttgcagttttgtggtgtggaatccacctgaatttgctcaggatttgcttcccaagtacttcaagcacaataacttctccagttttgtcaggcagcttaatacttatggatttaggaagattgatcctgatcagtgggagtttggtaacgaagaatttataagagggcagagacatattctaaagaatattcaccggcggaagccagttcatagccattccatgcagaatcatgggattatctctccgcttgctgaaacagaaaaacaggaatatgagaaggaaattaaccgactgaaacatgataagaacgaacttgagttggagctacagagaaacgaggcagagaagcagggatttgaatttcaaatcgtctcactgggtgagcgcttacagagtatggaatgcagacagaagcagttgatgtccttcctgggtcagctaatgcgaaaaccagagtttgcctctcttctcatgcagcagtctgaatatcataacaaaaagagaaagctactgaaacttgattacttccagggcgattacaaagaggagaatgagaatttgtgttctccaattgcaaacctggatggattgcctgctccaatgctgcatccggagtcggttgagaagttggattcatcattaaaattcttggaagattttctctatgctgttggtgaaagttttagtgaagaagtgtgccatgttggtgtcagatcacaaccttcaatggtcatagttagagaattaagttcatcctctgcagatggcgagccttggtctccaagatcatttccatcttcaccacattcgagggatattcgttcatcacctgagctggctagatgtatcaataatgttgtcagacaaacaactccaagttatctcggtgatgatacgatgcctgaatcttcacagttacaggcaaattgcaagcattctagagctccagcatctgaagtcataaaagcaccagcattagagatgaaaagtcctactgtggtgaatggagcaaatgatcttttctggcaacacttcctgactgaggcccccggtccgcatgatggacaagaatctgaaggtcgaacagaaagaaggattacagatgacataagaagcaataccaagccggacagtcacgagagatcttggtggaatacgaactacatagataatcttgcaaaaaatatgggacacattgcgacagctgaaagatcatga

SEQ ID NO: 353 - protein, 443 aa, Populus balsamifera subsp. trichocarpa
  misc_feature: Ceres ANNOT ID no.1471817
  misc_feature: Bit score of 129.4 for HMM based on sequences of FIGURE 12.
  misc_feature (13)..(182): Pfam Name: HSF_DNA-bind Pfam Description: HSF-type DNA-binding
  misc_feature: Functional Homolog Of Ceres LOCUS ID no. At1g32330 at SEQ ID NO. 311
MDGSQSNSSNAPPPFLTKTYDMVDDPLTNSVVSWSHSGCSFVVWNPPEFAQDLLPKYFKHNNFSSFVRQLNTYGFRKIDPDQWEFGNEEFIRGQRHILKNIHRRKPVHSHSMQNHGIISPLAETEKQEYEKEINRLKHDKNELELELQRNEAEKQGFEFQIVSLGERLQSMECRQKQLMSFLGQLMRKPEFASLLMQQSEYHNKKRKLLKLDYFQGDYKEENENLCSPIANLDGLPAPMLHPESVEKLDSSLKFLEDFLYAVGESFSEEVCHVGVRSQPSMVIVRELSSSSADGEPWSPRSFPSSPHSRDIRSSPELARCINNVVRQTTPSYLGDDTMPESSQLQANCKHSRAPASEVIKAPALEMKSPTVVNGANDLFWQHFLTEAPGPHDGQESEGRTERRITDDIRSNTKPDSHERSWWNTNYIDNLAKNMGHIATAERS

SEQ ID NO: 354 - DNA, 1473 bp, Populus balsamifera subsp. trichocarpa
  misc_feature: Ceres ANNOT ID no.1440896
  misc_feature: Encodes the peptide sequence at SEQ ID NO 355
atggaagcaggaccatcgtcagcgacctcaggaggtggtggtggtggtggaggaggaccggcgccgttcttggtaaagacatatgacatggtggatgattcatcgaccgacgagatcgtgtcttggagttcgaataaaaacagctttgttgtttggaaccctccagaattcgccagattgttgctccctacctttttcaagcacaataatttctctagctttatcagacaattaaatacctatggatttagaaagattgatcctgagagatgggaatttgccaatgaagattttgtgaaagatcaaaagcacctgcttaagaatatctaccgaagaaaaccaatccacagtcatagtcaacctcaaggttctttagtggatccagaaagagcagcatatgaggaagaaatagaaaagcttgcacgtgataaagctaaactcaaggcaagtattctagggtttgaacagcagcggtcatctgcaaagctacaggtggaagatctaacacagaagatagatactatgcagcagaggcaggaaaagctgctgtcgttcttagagaaggctgttcaaaaccctacttttgttgaacaccttgctcgtaagattgaagctatggatttttcagcctatagcaagaagagacgattgccccaagttgatcacccaatgccaattgcagaaaatagtcttgtggaaaatcacagtagttctagacctgagtcgaatgtcatccatcaagatttcccagataagttgagactggaattgtcaccagctgtttcagatattaatttggtttcacacagcacacagagctccaatgaagatgggggaagcccacaaagaaaaatatctgaagggaatccaaaagatgcactgactaggacatcaggtttactactggcacctgaaacattggaactttcagacacaggggcatcgtatgcatttaaagtgaatccagctgtcccaagagacataccagcaaatgggagcccagcactacattcactgcagtcgaatttgacttctaatgaagaagttgatggtcacatttcctgtcagctaaatcttagtctggcatcttctcctttgcaagtcaacaaaaatccttatttaactaggatacctcaactaggccaggaaattggcaaatctccagaatcaaggtttaatgagagtaacaaagattctgatatccgagttagtcagaacaacatgaatctgggtaacgaggtcagagctttatccaattcccaggaaaccccaaataacaatcaagcacctgcatcagctccggttagagtgaatgatgttttctgggaacagttcctaactgaaaggcccggctattctgataatgaagaggcaagttctaattacagagcaaacccatatgatgagagagaaagaaggataggtttcggagtgccaagaaatgctaaaaacatggagcagctctctctgtga

SEQ ID NO: 355 - protein, 490 aa, Populus balsamifera subsp. trichocarpa
  misc_feature: Ceres ANNOT ID no.1440896
  misc_feature: Bit score of 90.9 for HMM based on sequences of FIGURE 12.
  misc_feature (20)..(186): Pfam Name: HSF_DNA-bind Pfam Description: HSF-type DNA-binding
  misc_feature: Functional Homolog Of Ceres LOCUS ID no. At1g32330 at SEQ ID NO. 311
MEAGPSSATSGGGGGGGGGPAPFLVKTYDMVDDSSTDEIVSWSSNKNSFVVWNPPEFARLLLPTFFKHNNFSSFIRQLNTYGFRKIDPERWEFANEDFVKDQKHLLKNIYRRKPIHSHSQPQGSLVDPERAAYEEEIEKLARDKAKLKASILGFEQQRSSAKLQVEDLTQKIDTMQQRQEKLLSFLEKAVQNPTFVEHLARKIEAMDFSAYSKKRRLPQVDHPMPIAENSLVENHSSSRPESNVIHQDFPDKLRLELSPAVSDINLVSHSTQSSNEDGGSPQRKISEGNPKDALTRTSGLLLAPETLELSDTGASYAFKVNPAVPRDIPANGSPALHSLQSNLTSNEEVDGHISCQLNLSLASSPLQVNKNPYLTRIPQLGQEIGKSPESRFNESNKDSDIRVSQNNMNLGNEVRALSNSQETPNNNQAPASAPVRVNDVFWEQFLTERPGYSDNEEASSNYRANPYDERERRIGFGVPRNAKNMEQLSL

SEQ ID NO: 356 - protein, 801 aa, Chlamydomonas reinhardtii
  misc_feature: Public GI ID no.119393868
  misc_feature: Bit score of 76.8 for HMM based on sequences of FIGURE 12.
  misc_feature (9)..(207): Pfam Name: HSF_DNA-bind Pfam Description: HSF-type DNA-binding
  misc_feature: Functional Homolog Of Ceres LOCUS ID no. At1g32330 at SEQ ID NO. 311
MTNPANQPPPFLIKTYDLVDDPSTDNIVSWGADGHSFIVWKPPEFARDLLPKHFKHNNFSSFVRQLNTYGFRKVDPDRWEFANEHFVRGKKEQLRDIHRRKPSATHNATGTGGGASGAAAGAAAATPGAPVPSNALVAAGQTAPAIEIGAYGGFREEIDNLKRDKNVLMVELVRLRQQQATADAKIRDLTGRLENTEAKQQTMINMFAAAFKNPAMFQRMLSTMASSGVQRLTAAPAYSGGAGAAGGRRKRRARGETSVTDIGEDIAGTGVGITEAIDADMLETGGANHMAVNGVHGAAGSPPSHGHGADDTSSNGSATDATGAANGYGHQLVAYNPAVAAAAAAAGAAGGSSAAAVSGGAASTDALSEMMMRSFQSLLSGAEDMTGDVTGALNSLAIGQGGGVGGGGAHVGHALGAHMVPSAAAPHVTIQEQPSTSAAAAAAAAAGGGTPTTSSVVLMGSSAPGVVVNSTGGAVVDPTSGAAGLISTAIQPYQGPAALPGLPQGVAVGGVTGLSGLGPGTTLLAPGAMATAPHAPGAHPTPSAFVITKPEPMLGGAPGPVLPVGTPGMVPVQPSTGPGSSAAMTASALPTSAFAALAGVPAVPMPVPAVPMAGAAGPSVPIPMPGSAAATPVPMVPVVMSPPPPGHTMIPIQTATMAPPTQAMGAAGLRVPSGLPAINNMALTPAAAAAAAAAAAAAAMPGSGGLFDATPTSAAGLPVNDNPTVTSPPADADGVDGMLGGLSGLDLMTSLPSGELVLPSDGDFGDDVWAQIMSAASAQAPDAAGGLGGLDLNPVSAALEH

SEQ ID NO: 357 - DNA, 1179 bp, Populus balsamifera subsp. trichocarpa
  misc_feature: Ceres ANNOT ID no.1517025
  misc_feature: Encodes the peptide sequence at SEQ ID NO 358
atggtgaaatcaagcgaaagtggggtggctcctttcttgaagaaatgctatgaaatggttgatgatgaatcaacaaattcgataatctcatggagccagaccaatgacagctttgttatatgggacatgactgaattctctgtccacttattgcctaagtacttcaagcacagcaattcttctagttttgtcaggcagctcaatatctatggatttagaaaaattgatacagatcagtgggaatttgcaaatgacggatttatcagagggcagaaacatttgttaaagaatatctgcaggaggaaaaattctcagggcacagacaatcgaaagtcagtgcagcagcaagacaactccattgagcattgtgaaaatgttgaaaatgtgggtctctggaaggaagttgagagcctgaagacaggtagaaatgcagttacacaggagttggttaagctcaggcagcaccaggaaactgcagacaataagttgctcctgttgagggatcgccttcaaggaatggaaaaaaatcagcagcagatgctgtcttttttagtgatggcaatgcaaagcccagggtttctagctcagctactaaacaaaaaggaaaataattggcggatagctgagccaggaagcatagtggagcagggtgcagatgatgctgagcagttggcttctgagggaatgatagtaaggtaccagccaccagtggatgagatgttcgagcctgtacatgcaccgccaattggtccagaaaatccacgagaatctaacccatcttccgatgggatgaaagatttttttgtgagtccagattttatggaacttcttatggatgaaaatttgggttttgaaaatcatacctcgtttggtttaccagaattagcggatgatggttcttgggaacaactgcttttagccaatcctttcattgagaatattaaagacaccaaacccggttctgaagagagcactgatactgaaactgataccggaacaacaattgttggaacgcagctggagagatcccaaagttttgaatatttaatagaaatgatggagaagtccaatgacttggagaacaaagcaactgatgaaggacctcactttgagaagtctcagaaattggaaattctaactgagcagatgggtcttttggcttcggagccaaaccactaa

SEQ ID NO: 358 - protein, 392 aa, Populus balsamifera subsp. trichocarpa
  misc_feature: Ceres ANNOT ID no.1517025
  misc_feature: Bit score of 127.7 for HMM based on sequences of FIGURE 12.
  misc_feature (10)..(184): Pfam Name: HSF_DNA-bind Pfam Description: HSF-type DNA-binding
  misc_feature: Functional Homolog Of Ceres LOCUS ID no. At1g32330 at SEQ ID NO. 311
MVKSSESGVAPFLKKCYEMVDDESTNSIISWSQTNDSFVIWDMTEFSVHLLPKYFKHSNSSSFVRQLNIYGFRKIDTDQWEFANDGFIRGQKHLLKNICRRKNSQGTDNRKSVQQQDNSIEHCENVENVGLWKEVESLKTGRNAVTQELVKLRQHQETADNKLLLLRDRLQGMEKNQQQMLSFLVMAMQSPGFLAQLLNKKENNWRIAEPGSIVEQGADDAEQLASEGMIVRYQPPVDEMFEPVHAPPIGPENPRESNPSSDGMKDFFVSPDFMELLMDENLGFENHTSFGLPELADDGSWEQLLLANPFIENIKDTKPGSEESTDTETDTGTTIVGTQLERSQSFEYLIEMMEKSNDLENKATDEGPHFEKSQKLEILTEQMGLLASEPNH

SEQ ID NO: 359 - DNA, 1182 bp, Populus balsamifera subsp. trichocarpa
  misc_feature: Ceres ANNOT ID no.1512410
  misc_feature: Encodes the peptide sequence at SEQ ID NO 360
atggtgaaatcaagcgatagtggggtggctcctttcttgaagaaatgctatgaaatggtaggtgatgagtcaacaaattcgataatctcatggagccaaaccaatgacagctttgtcatatgggacatgactgaattctgtgtccacttgttgcccaagtacttcaagcacagcaattcttctagttttgtcagacagctcaatatctatggatttagaaagattgatacagatcattgggaatttgcaaatgatggatttatcagagggcagaaacatttgttaaagaatatcagcaggaggaaaaattcacagggcacagacaatcgaaaattagtgcagcagcaggacaactccgtggaacaccatgaaagcgttgaaaatgcgggtctctggaaggaagttgagaacctaaagactggtaaaattgcactgacgcaggagttggttaagctcagccagcaccaggaaactgcagacaataagttgctccttttgagggatcggcttcagggaatggaaaagaatcagcagcagatgctgtctttcttagtgatggcaatgcaaaaaagcccagggtttctagctcagctactacacaaaaaggaaaataattggcggatggctgagccaggaagcattgtggaacaggttgcagatgatgctgacccattggcttctgaggggatgatagtaaagtaccagccaccagtggatgagacatttgagcccatgcatgcaccaccgattggtccagaaaatccacgagaatctaacccatcttctgatgggatgaaagattttttttttagttcagaattcacggagctgcttatggatgagaatttgggttttgaaaatcacgccccattcgttctaccagaattagcagatgatggtgcttgggagcagctgcttttagccaatccttttgttgcaaacattaaagattccgaaacagattatgaagagcccactgatgctgaaactgatacaggaacagcagttccaggaacacagctggacagatctcaagattttgaaaatttaattgaacaaatggagaagtatcataacttggaaaaccaagctactgatgaaggtcctcacttcgagaagcctcggaacttggaaattctaactaagcagatgggtcttttggcttctgagacaaaccactaa

SEQ ID NO: 360 - protein, 393 aa, Populus balsamifera subsp. trichocarpa
  misc_feature: Ceres ANNOT ID no.1512410
  misc_feature: Bit score of 120.1 for HMM based on sequences of FIGURE 12.
  misc_feature (10)..(184): Pfam Name: HSF_DNA-bind Pfam Description: HSF-type DNA-binding
  misc_feature: Functional Homolog Of Ceres LOCUS ID no. At1g32330 at SEQ ID NO. 311
MVKSSDSGVAPFLKKCYEMVGDESTNSIISWSQTNDSFVIWDMTEFCVHLLPKYFKHSNSSSFVRQLNIYGFRKIDTDHWEFANDGFIRGQKHLLKNISRRKNSQGTDNRKLVQQQDNSVEHHESVENAGLWKEVENLKTGKIALTQELVKLSQHQETADNKLLLLRDRLQGMEKNQQQMLSFLVMAMQKSPGFLAQLLHKKENNWRMAEPGSIVEQVADDADPLASEGMIVKYQPPVDETFEPMHAPPIGPENPRESNPSSDGMKDFFFSSEFTELLMDENLGFENHAPFVLPELADDGAWEQLLLANPFVANIKDSETDYEEPTDAETDTGTAVPGTQLDRSQDFENLIEQMEKYHNLENQATDEGPHFEKPRNLEILTKQMGLLASETNH

SEQ ID NO: 361 - DNA, 1584 bp, Sorghum bicolor
  misc_feature: Ceres ANNOT ID no.6035498
  misc_feature: Encodes the peptide sequence at SEQ ID NO 362
atgcagggcggtgtcgtggcccacgccgccgccgccgcggcggccgcgtcgacggtgaccactgcggtggcgcctccggtgccggcgcacgcggcggtggtgggaaacggcggcgggccggcggccgccgcgccgccgccaccgttccttatgaagacgtacgagatggtggacgacccggccaccgacgacgtcgtgtcctggggccccgggaacaacagcttcatcgtctggaacacgcccgagttcgccagggacctcctgcccaagtacttcaagcacagcaacttctcatcattcgtcaggcagctcaacacctacgggtttagaaaggttgatccagacagatgggaatttgcaaatgagggttttcttagaggacaaaaacatctgctgaagactatcaacagaaggaaaccatccttgcaggggaacagccaaccacagcaacctcagttgcagaatgctcctgtgccttcctgtgtagaggtgggcaagtttgggttggaggaagagatagaacggctgaaaagggataagaatgttcttatgcaagagcttgtcaggctgagacagcaacagcaaacaactgaccatcagcttcagactttgggcaagcgtcttcaagggatggagtcacggcagcaacagatgatgtctttcctggctaaggcaatgcaaagtcctggtttcctagcacagtttgtacagcaaaacgagaatagtagaagaagaatagtagctgcgaacaagaaaaggcggctacccaagcaagatggtggcctagactctgaaagtgctgctgcttcgttagacggtcaaattatcaagtatcaacctttgatcaacgaagcagccaaagcaatgctaaggaagatcctaaagctagattcttcgcataggtttgaatctatgggcaattcagataataataattttctgctggagaattatatgccagctgctcaagcttttgagagctcttcgtcaacaagaaattctggggtcacccttgcagaggttccagctaactcgggcttgccctatgtcagcgcaagctctggactgtcagctatctgttctccttcagtggctcctgaaatccagtgcccagttgtgctggacaacaagttgtctaaccaagtgcccaacatgagtgctgtgcctcctgtttcaaaccctataacagcaggctcaagtgacatcagcattccggaattctcagatctggcggacttggtaaacgaagactctgtcaatattcctggaggggcctttgagatgcctggtcctgagtttcccctgccagaaggtgatgacagtgtccccatcgagactgatgagaccatgtacaacaatgacgagactcagagccttccaggcatcatcgactccttctgggagcagttcctggtaggcagccctctatccgccgataatgatgaagttgattcaggcggactagatgcaaggggttcaccacaggagaatgggtggagcaaagtggggaacatctccaatcttacagaacagatgggccttctatcatcaacaaatcaccgggactcagggaatgggctgtaa

SEQ ID NO: 362 - protein, 527 aa, Sorghum bicolor
  misc_feature: Ceres ANNOT ID no.6035498
  misc_feature: Bit score of 1070.3 for HMM based on sequences of FIGURE 12.
  misc_feature (47)..(222): Pfam Name: HSF_DNA-bind Pfam Description: HSF-type DNA-binding
  misc_feature: Functional Homolog Of Ceres LOCUS ID no. At1g32330 at SEQ ID NO. 311
MQGGVVAHAAAAAAAASTVTTAVAPPVPAHAAVVGNGGGPAAAAPPPPFLMKTYEMVDDPATDDVVSWGPGNNSFIVWNTPEFARDLLPKYFKHSNFSSFVRQLNTYGFRKVDPDRWEFANEGFLRGQKHLLKTINRRKPSLQGNSQPQQPQLQNAPVPSCVEVGKFGLEEEIERLKRDKNVLMQELVRLRQQQQTTDHQLQTLGKRLQGMESRQQQMMSFLAKAMQSPGFLAQFVQQNENSRRRIVAANKKRRLPKQDGGLDSESAAASLDGQIIKYQPLINEAAKAMLRKILKLDSSHRFESMGNSDNNNFLLENYMPAAQAFESSSSTRNSGVTLAEVPANSGLPYVSASSGLSAICSPSVAPEIQCPVVLDNKLSNQVPNMSAVPPVSNPITAGSSDISIPEFSDLADLVNEDSVNIPGGAFEMPGPEFPLPEGDDSVPIETDETMYNNDETQSLPGIIDSFWEQFLVGSPLSADNDEVDSGGLDARGSPQENGWSKVGNISNLTEQMGLLSSTNHRDSGNGL

SEQ ID NO: 363 - DNA, 1362 bp, Arabidopsis thaliana
  misc_feature: Ceres LOCUS ID no.At2g26150
  misc_feature: Genomic Sequence
  misc_feature: Inplanta Sequence
  misc_feature: Encodes the peptide sequence at SEQ ID NO. 364
atggaagaactgaaagtggaaatggaggaagaaacggtgacgtttactggttctgtagcggcttcttcatctgtaggatcctcttcctctcctagaccaatggaagggcttaacgaaacagggccaccaccgtttctgactaagacttacgaaatggtggaagatccggcgacggacacggtggtttcttggagtaatggtcgtaacagctttgtggtgtgggattctcataagttctcaacaactctccttccacgttacttcaagcatagcaatttctcaagttttattcgtcagctcaatacttatgtaagtacctctttgcttccttatatctacttagtcttgtttctgtttttgtttctaatttttaattttggatttctttagatgggtttcctatgagtcttcagctataaaggttagttctttaagcttttaagtggctaaattgaaattagatgcattgagattttggtcatatgttaagagaatcatttaacataaactctgttcaatcctctgtttctgaagttcaaaatgtgtttggtagtaaaaacagaatcttggaatgataagtaaggactctgcctcaagttcagtagctgatgaaacttgttttggtgattgcagggattcagaaagattgatccagatagatgggaatttgcaaatgaagggtttttagcaggacaaaagcatctcttgaagaacatcaaaagaaggaggaacatgggtttgcagaatgtgaatcagcaaggatctgggatgtcatgtgttgaggttgggcaatacggtttcgacggggaggttgagaggttgaagagggatcatggtgtgcttgtagctgaggtagttaggttgaggcaacagcaacacagctccaagagtcaagttgcagctatggagcaacggttgcttgttactgagaagagacagcagcagatgatgacgttccttgccaaggcgttgaacaatccgaactttgttcagcagtttgcggttatgagtaaagagaagaagagtttgtttggtttggatgtggggaggaaacggaggcttacttctactccaagcttggggactatggaggagaatttgttacatgatcaagagtttgatagaatgaaggatgatatggaaatgttgttcgctgcagcaatcgatgatgaggcgaataattcgatgcctactaaggaggaacaatgtttggaggctatgaatgtgatgatgagagatggtaatttggaagcagcgttggatgtgaaagtggaagatttggttggttcgcctttggattgggacagccaagatctacatgacatggttgatcaaatgggttttcttggttcggaaccttaa

SEQ ID NO: 364 - protein, 345 aa, Arabidopsis thaliana; identical to SEQ ID NO: 350
  misc_feature: Ceres LOCUS ID no.At2g26150
  misc_feature: Bit score of 868.1 for HMM based on sequences of FIGURE 11.
  misc_feature (43)..(212): Pfam Name: HSF_DNA-bind Pfam Description: HSF-type DNA-binding

SEQ ID NO: 365 - DNA, 1857 bp, Populus balsamifera subsp. trichocarpa
  misc_feature: Ceres ANNOT ID no.1485538
  misc_feature: Encodes the peptide sequence at SEQ ID NO 366
atggatggaataaacaccactgcaagcggtggcgacgcctctactagcggcggtgtagcactagcggcgccggtgccgatggcgtcccagtcaaattctccgccgccatttctgagtaagacttacgacatggtagacgacccggagaccgacgccgtggtgtcttggagttcgacgaataatagttttgtggtttggaatccgccggagttcgctcgcgatcttttgccgaacaaccaaatggagcagaaactgaacaagaaaatagaagtgtgccttatgttgaccatacaagataaaaagctatctagtcaaggtgtcaatattatctcttgctgcatgtggaagttcagcaagagcttatctttcaactttgatattacatcaaggaaattctggcaaaattttccaagctgtctagaaaaggtgtccgtattttctcttgctgcatgtggaagctcagcaagagcttatcctttcaatttcaatattgtgtcaaggcaattctggcacttatttttaaatcaagaggaaatgcagtttcctttctcagaatacaggggggcattgtactccctacaaaagttggaatgcctttaccacgagcaaggttttcgaaaggtggatccagaccgttgggaattcgccaatgaaggatttttgaggggtcagaagcacctgcttaggactatcagtcggcgaaaacctgcccatggacatactaatcaacagccgcaacaagctcgtggacagaactcaactgttggcgcttgtgttgaggttggaaaatttgggcttgaggaagaggtagagaggcttaagagggacaagaatgttcttatgcaagaacttgttaggttgaggcagcagcaacagtccacggatagccagttgcaaaccatggtgcagcgacttcaagggatggagcagcgtcagcaacagatgatgtcattcctggcaaaggctatgcagagcccgggcttcctggctcagtttgtacagcagcaaaatgaaagcagcaggcgcataacagaagccaacaaaaaacgaaggctcaagcctgaggatgtttctgagaatgagggttctagtgctcctgatggacagattgtgaagtatcagcctcagatgaacgaggcagccaaagcaatgctcaggcaggtcatgaaaatggatgctccttctaggttggaatcttatgacaccaatcttgatggcttcctgattggtaatggttcaccatcatctagtgcaaaagacagcggaagctcttcaagccgcatgtcaggagtgactcttcaagaggtcccagcagcttcagggatttccggacatggccccatggctgccatatctgaaatacaatcttccccacacattgctagctcagaaaaggctacagcttctcagtttccggaaagtatactggttggaggacaaggagcaccctccatacctattccacaggcagatataatcatgccccaggtttctcaaaagccagaaatggtgccagaaattattgctgatattcctggtgaagattacatggaaccagagacaagcagtgatgtgttcctagatccagcttcacttggaattaatgatacaatacccatagatattgacaacatctcccctgatcctgatatcgatgctttgcttgataattctagcttctgggatgaccttcttgcgcagagtccagtgcctgaggatattgaatcaagttctgtggagggtaaagccaatggaaatgatgtacatcaaattataaacgggtgggacaaagctcagcatatggatcagctgacagaacaaatgggacttctctcatcagatcgcaagcagctttaa

SEQ ID NO: 366 - protein, 618 aa, Populus balsamifera subsp. trichocarpa
  misc_feature: Ceres ANNOT ID no.1485538
  misc_feature: Bit score of 568.2 for HMM based on sequences of FIGURE 11.
  misc_feature (204)..(319): Pfam Name: HSF_DNA-bind Pfam Description: HSF-type DNA-binding
  misc_feature: Functional Homolog Of Ceres LOCUS ID no. At2g26150 at SEQ ID NO. 364
MDGINTTASGGDASTSGGVALAAPVPMASQSNSPPPFLSKTYDMVDDPETDAVVSWSSTNNSFVVWNPPEFARDLLPNNQMEQKLNKKIEVCLMLTIQDKKLSSQGVNIISCCMWKFSKSLSFNFDITSRKFWQNFPSCLEKVSVFSLAACGSSARAYPFNFNIVSRQFWHLFLNQEEMQFPFSEYRGALYSLQKLECLYHEQGFRKVDPDRWEFANEGFLRGQKHLLRTISRRKPAHGHTNQQPQQARGQNSTVGACVEVGKFGLEEEVERLKRDKNVLMQELVRLRQQQQSTDSQLQTMVQRLQGMEQRQQQMMSFLAKAMQSPGFLAQFVQQQNESSRRITEANKKRRLKPEDVSENEGSSAPDGQIVKYQPQMNEAAKAMLRQVMKMDAPSRLESYDTNLDGFLIGNGSPSSSAKDSGSSSSRMSGVTLQEVPAASGISGHGPMAAISEIQSSPHIASSEKATASQFPESILVGGQGAPSIPIPQADIIMPQVSQKPEMVPEIIADIPGEDYMEPETSSDVFLDPASLGINDTIPIDIDNISPDPDIDALLDNSSFWDDLLAQSPVPEDIESSSVEGKANGNDVHQIINGWDKAQHMDQLTEQMGLLSSDRKQL

SEQ ID NO: 367 - DNA, 1512 bp, Populus balsamifera subsp. trichocarpa
  misc_feature: Ceres ANNOT ID no.1538505
  misc_feature: Encodes the peptide sequence at SEQ ID NO 368
atggattgtcaacagtcttctagtgcagggtcgatatttgttgaagatttaagcttccctgctgccgcaccttctcctttaatggacctggaggctttctcctatgtaagcccgacgacttcagctcatccagtatcatcatcggcgactgccaacgaggtggatgaggaagaggagatgccacgtcctcttgtgtgcttacaggagaatccagtaccgccttttctatcgaaaacatatgatctggtggatgatcggatgctggacccaataatttcgtggggttccattggggagagtttcgtggtgtgggaccccgaggagttcgccaggcttgttctccctcggaatttcaagcacaacaatttctccagttttgtccgacaactcaatacttatgggttccgcaagattgatactgatcgatgggagtttgccaatgaatctttcagaagaggcgagaagcatctgttgaagaacattcataggcgcaaatcaacacagtcccagcaggttgggagccacacggggtctttaactgaagcagggaggtctggattggatagtgaggtagaaagattaaggaaggagcggagtgtgatgatgcaggaagttatagaactgcagaagcagcagtctgggactgttcacgatgtgcaatcagtaaatcagagacttcaggcagcagagcaaaggcagaagcagatggtttcgttcttggcaaagttgtttcagaatccagcattcttagcccgtctcaagcaaaagaagcaacagggagagattggttcatcaaggatgaagaggaagtttgttaagcaccagcaacaccaacatgccctacctgaatcatcaatggaagggcagattatgagatacatgcctgattggagaaacatcacattatcttctgtggtcccggatacaagtccagcctctattgatcaatctcctgattatctctcagaaggcatggtaggcctgggtcttggcagtgaagcaatgccattacctgaaattgttgcacctgatgaatttgccatctcagacgaattaggattgggacagggatttatcaaaacaccagagcaggttggagaagggcaatcaagcatgcaatttgaagatcccaagctcaaaggaaagattgatatgagcccgcaaaatgaggctggtcttgaatattttgtctcttttcctgaggatttggggatggagaaaagctttccagaattatcttcccctggcatggaaagaattgttaaacaagaggatgtatggagtttggcatttaacactagtgctggtatgtctagttctagcaatgttccatgggataattttttcggatatgatatgccagagttgggatcaacaggtggcttctcagatatctgggatataggttctggacaagcaggaggaggtttgagcatggataagtggctggctgatgaaagtcccgttgatgagtctgatagtcaagctggccagccaaaagatgataaataa

SEQ ID NO: 368 - protein, 503 aa, Populus balsamifera subsp. trichocarpa
  misc_feature: Ceres ANNOT ID no.1538505
  misc_feature: Bit score of 152.5 for HMM based on sequences of FIGURE 11.
  misc_feature (73)..(240): Pfam Name: HSF_DNA-bind Pfam Description: HSF-type DNA-binding
  misc_feature: Functional Homolog Of Ceres LOCUS ID no. At2g26150 at SEQ ID NO. 364
MDCQQSSSAGSIFVEDLSFPAAAPSPLMDLEAFSYVSPTTSAHPVSSSATANEVDEEEEMPRPLVCLQENPVPPFLSKTYDLVDDRMLDPIISWGSIGESFVVWDPEEFARLVLPRNFKHNNFSSFVRQLNTYGFRKIDTDRWEFANESFRRGEKHLLKNIHRRKSTQSQQVGSHTGSLTEAGRSGLDSEVERLRKERSVMMQEVIELQKQQSGTVHDVQSVNQRLQAAEQRQKQMVSFLAKLFQNPAFLARLKQKKQQGEIGSSRMKRKFVKHQQHQHALPESSMEGQIMRYMPDWRNITLSSVVPDTSPASIDQSPDYLSEGMVGLGLGSEAMPLPEIVAPDEFAISDELGLGQGFIKTPEQVGEGQSSMQFEDPKLKGKIDMSPQNEAGLEYFVSFPEDLGMEKSFPELSSPGMERIVKQEDVWSLAFNTSAGMSSSSNVPWDNFFGYDMPELGSTGGFSDIWDIGSGQAGGGLSMDKWLADESPVDESDSQAGQPKDDK

SEQ ID NO: 369 - protein, 508 aa, Lycopersicon peruvianum
  misc_feature: Public GI ID no.8347238
  misc_feature: Bit score of 172.9 for HMM based on sequences of FIGURE 11.
  misc_feature (95)..(258): Pfam Name: HSF_DNA-bind Pfam Description: HSF-type DNA-binding
  misc_feature: Functional Homolog Of Ceres LOCUS ID no. At2g26150 at SEQ ID NO. 364
MNPFDKKQEPDTDSKTPFLTEMDSEFAAFSPISLPFADPSSPFINFGSFATPLSQHPVGEGEREGEGEGGEIEQPAEGGLGVPQPMECLHGIQIPPFLSKTFDLVEDPLLDTIISWGTNGESFVVWDPVEFSRLVLPRNFKHSNFSSFVRQLNTYGFRKIDADRWEFANEGFSRGKRHLLKNIQRRRSQQGGSSSGSSAEAGKGTMDEIEKLRNEKSLMMQEVVELQQQQHGTVQLMESVNEKLQAAEQRQKQMVSFLAKVLQNPTFLARVRQMKEQGEITSPRTMRKFVKHQSHGPDGVGSSSMEGQIVKFRSDFQDLAGCFDSPDFNPVVDQQLPETGLGAEAMPFEGGPVADGLTVAHELLNCSDREIRGASFFNSGGSQFKGKNVASPQIEVMPEYFASFPEEMGKEKNISGFSAPAIGSMVKDEELWGMGFEASAGMPSTGPELWDSLSSYVPDFGVSSGLSDLWDIDPLQVAGSSGVDKWPADGSPFGQSESHANQPKNDSF

SEQ ID NO: 370 - protein, 406 aa, Oryza sativa subsp. indica
  misc_feature: Public GI ID no.125542955
  misc_feature: Bit score of 239.4 for HMM based on sequences of FIGURE 11.
  misc_feature (49)..(225): Pfam Name: HSF_DNA-bind Pfam Description: HSF-type DNA-binding
  misc_feature: Functional Homolog Of Ceres LOCUS ID no. At2g26150 at SEQ ID NO. 364
MGSKKRSPQHPAAAAPPPAVGGGGGGEVSGDGGASTANGPVVPKPSEVAPFLTKVYDMVSDPATDNVISWAEGGGSFVIWDSHAFERDLHRHFKHSNFTSFIRQLNTYGFRKVHPDRWEWANEGFIMGQKHLLKTIKRRKKSSQEAPSEIQKAPVKTAPGTENIEIGKYGGLEKEVETLKRDKALLMQQLVDLRHYQQTSNLEVQNLIERLQVMEQNQQQMMALLAIVVQNPSFLNQLVQQQQQQRRSNWWSPDGSKKRRFHALEQGPVTDQETSGRGAHIVEYLPPVPETSGQVNPVEGAICSANSQPVPSPAVATPMDMQTSNVADTLGSSEEPFADNSTLHEWDDNDMQLLFDDNLDPILPPFENDGQMGPPLSVQDYDFPQLEQDCLMEAQYNSNNPQYGND

SEQ ID NO: 371 - protein, 475 aa, Oryza sativa subsp. japonica
  misc_feature: Public GI ID no.115446219
  misc_feature: Bit score of 199.3 for HMM based on sequences of FIGURE 11.
  misc_feature (19)..(186): Pfam Name: HSF_DNA-bind Pfam Description: HSF-type DNA-binding
  misc_feature: Functional Homolog Of Ceres LOCUS ID no. At2g26150 at SEQ ID NO. 364
MEVAAGARGGGAGGGGGGPAPFLLKTYEMVDDPSTDAVVSWSDASDASFVVWNHPEFAARLLPAYFKHSNFSSFIRQLNTYGFRKIDPERWEFANEYFIKGQKHLLKNIHRRKPIHSHSHPPGALPDNERAIFEDEIERLSREKSNLQADLWKSKQQQSGTMNQIEDLERRVLGMEQRQTKMIAFLQQASKNPQFVNKLVKMAEASSIFTDAFNKKRRLPGLDYSIENTETTSFYDDHSSTSKQETGNLLNQHFSDKLRLGLCPAMTESNIITLSTQSSNEDNRSPHGKHPECDMMGRECLPLVPQMMELSDTGTSICPSKSSCFAPPISDEGLLTCHLSLTLASCSMDVDKSQGLNANGTTIDNPTEAATATMEKDDTIDRSFDDNQKKSADSRTADATTPRADARVASEAPAAPAAVVNDKFWEQFLTERPGCSETEEASSGLRTDTSREQMENRQAYDHSRNDREDVEQLKL

SEQ ID NO: 372 - DNA, 2183 bp, Zea mays
  misc_feature: Ceres CLONE ID no.1597127
  misc_feature: Encodes the peptide sequence at SEQ ID NO 373
aacagatacatggccggccgtctctgagccggtctcccggcagcagcagtcccccgggttgtccacgcggagcgccagccgatggccggccacagtatgtcggttcacccgaagcctataaattcctcgccgccccgcctctcgccgcccatttccctccgccgcctcctaattctcaacacccgcgcccccaccgcgcccgtcgtatgccaccatgcaccgcgcccgccccaccgcgcacgctaatgaccccgatgctccgtacgccgccgccgacgccgcgatgctgctggagcccaaactcgaggacgaggagttgctgctggagcccaaactcgaggacgaggagttgccgctgcagcagctggcgtccccgggcaccttcgtgtccctggaccagctgatgccgccggtgaccgcgccagccgagccgcgcccgctggaggcgctgctgcacggcccgcagctgccgcccttcctgtccaagacgtacgacctggtgaacgagccggcgctggacggggtcatctcctggggcgctgccgggaacagcttcgtcgtgtgggacccctccaccttcgcgcgggatgtgctgccgcacaacttcaagcacaacaatttctccagcttcgtcaggcagctcaacacctatggtttccgcaaggttcatgctgacagatgggagtttgctcacgaagatttcctgcgagatagcaagcatctattgaagaggattgtcaggcgcaggtcctccccaacaaaacaaagcagcgttcagcctggctcttcttctggagaatccagcttggaccctgagctccacacgctgaggagagagaagaacgcgctgcttgaagaagtagcaaggttgaaacaggaacaccgccagacaattgagcaaatgagcacgctgaatcacaggctggaatctgcagaggaccggcagaggcagatggtctctttcctggccaagctccttcagaacccgagtttcgtgaggaagctgaagctgcacagggagaagaaggagatcgactccaccagggtgaaaagaaagtttctcaaacatgttcctcatggcagcgtagagtcaggtgaatccagctcacagcacgccggagagagtggttcgtatttcgctgtgagttcccccatggctacaactacaagcgtgcatgacgacatcacggagcttcagaactttcttttggaagatgatgatctcaacttcggcatggattcagagaacaccgggcttgaaggcaccgaggcaacagatgatattggagaactgatttaggggttcgacacacaagaggaacttgacctcggcagtggagctgagctacaggagatgcctccagcttctggttctcttgctcaagatcccacaatcggcaggttcaagggaaagaatgtgctgtgtccaggactggacgctacctcctccgaaggcgactgcctcagtccattgcctgacaacatggggctgctttcaggcaccatgctagggacagcaggaagcatgatggccgctgacgatgagcaaatatggggcgttgatgcttcggcagccctgcaaagctcttgcagtggcactagccaacaagctttcggtagccatgccagtgatccctatctgatggacatcgccaacaggcctgagagattctgggagcttgatttccaggcactggatgaggctgatctgcagctggacaagtgtgctatcgatgaccctgctcttcagcagcagccaagcatgaagaagccgtagacgtggtgctttatccactgaagtgctacgattaacttatggacattgctatagttacttcggtatttgggagcgaggctgatgaactcgcctactatggcacttaatagtagcagcagcagtagtatgtttttgtttcccatttattcacccccggtgtttttgaatggaaacttgtatcctagtgatttcttcagagcagctgttaactgctctggcttattctttttttgtttccatttatgtttttgttctgattcttttacttgctagttgctacttgcgaatgtcttgcaatgagtaatgggattttaaaaaaaatccgttctcagagaaccaaacgatgtactgatgtgctgctgaatgccaagaagtggctgaattctgtttaaaaaaaaaaaaaaaa

SEQ ID NO: 373 - protein, 361 aa, Zea mays
  misc_feature: Ceres CLONE ID no.1597127
  misc_feature: Bit score of 145.7 for HMM based on sequences of FIGURE 11.
  misc_feature (86)..(251): Pfam Name: HSF_DNA-bind Pfam Description: HSF-type DNA-binding
  misc_feature: Functional Homolog Of Ceres LOCUS ID no. At2g26150 at SEQ ID NO. 364
MHRARPTAHANDPDAPYAAADAAMLLEPKLEDEELLLEPKLEDEELPLQQLASPGTFVSLDQLMPPVTAPAEPRPLEALLHGPQLPPFLSKTYDLVNEPALDGVISWGAAGNSFVVWDPSTFARDVLPHNFKHNNFSSFVRQLNTYGFRKVHADRWEFAHEDFLRDSKHLLKRIVRRRSSPTKQSSVQPGSSSGESSLDPELHTLRREKNALLEEVARLKQEHRQTIEQMSTLNHRLESAEDRQRQMVSFLAKLLQNPSFVRKLKLHREKKEIDSTRVKRKFLKHVPHGSVESGESSSQHAGESGSYFAVSSPMATTTSVHDDITELQNFLLEDDDLNFGMDSENTGLEGTEATDDIGELI

SEQ ID NO: 374 - DNA, 2272 bp, Zea mays
  misc_feature: Ceres CLONE ID no.1584568
  misc_feature: Encodes the peptide sequence at SEQ ID NO 375
acctccgcctcccggcgcccgcatcgcctctcgcctgcgctgcgctttctttcccccaagatattttccggccgctctaccctgtagctgtagcgcgtgcgcgcaccgccttgccctgcggtccgcagccacgagactgccctgccccgccgccaagtggccagaatcccgccgcggggcccgccgcgatcgcccaccaaaaccaccctcgggctcgggtatactacacagatacatggccggccatctctgagccggtctcccggcagcagcagtccctcgggttgtccacgcggagcgccagccgatggccggccacagtatgtcggttcacccgaagcctataaattcctcgccgccccgcctctcgccgccccgcctctcgccgccccgcctctcgccgcccatttccctccgccgcctcctaatcctcaacacccgcgcccccaaccgcgcccgtcgtatgccaccatgcaccgcgcccgccccaccgcgcacgctaatgaccccgatgctccgtacgccgccgccgtcgcgatgctgctggagcccaaactcgaggacgaggagttgccgctgcagcagctggcgtccccgggccccttcgtgtccctggaccagctgatgccggcggtggccgtgccggccgaaccgcgcccgctggaggcgctgctgcaaggcccgcagctgccgcccttcctgtccaagacgtacgacctggtgaacgagccggcgctggacggggtcatctcctggggcgctgccgggaacagcttcgtcgtgtgggacccctccaccttcgcgcgcgacgtgctgccgcacaacttcaagcacaacaatttctccagcttcgtcaggcagctcaacacctatggtttccgcaaggttcatgctgacagatgggagtttgctcacgaagatttcctgcgagatagcaagcatctattgaagaggattgtcaggcgcaggtcctccccaacaaaacaaagcagcgttcagcctggctcttcttctggagagtccagcttggaccctgagctccacacgctgaggagagagaagaacgcgctgcttgaagaagtagcaaggttgaaacaggaacaccgccagacaattgagcaaatgagcacgctgaatcacaggctggaatctgcagaggaccggcagaggcagatggtctctttcctggccaagctccttcagaacccgagtttcgtgaggaagctgaagctgcacagggagaagaaggagatcgactccaccagggtgaaaagaaagtttctcaaacatgttcctcatggcagcgtagagtcaggtgaatccagctcacagcacgccggagagaatggttcgtatttcgctgtgagttcccccatggctacaactacaagcgtgcatgacgacatcacggagcttcagaactttcttttggaagatgatgacctcaacttcggcatggattcagaaaacaccgggcttgaaggcaccgaggcaacagatgatattggagaactgattcaggggttcgacacacaagaggaacttgacctcggcagtggagctgagctacaggagatgcctccagcttctggccctcttgctcgagatcccacaatcggcaggttcaagggaaagaatgtgctgtgtccaggactggacgctacctcctccgaaggcgactgcctcagtccattgcctgacaacatggggctgctttcaggcaccatgctagggacggcaggcagcatgatggccgctgacgatgagcaaatatggggcgttgatgcttcggcagccctgcaaagctcttgcagtggcactagccaacaagctttcggtagccatgctagtgatccctatctgatggacatcgccaacaggcctgagagattctgggagcttgatttccaggcactggatgaggctgatctgcagctggacaagtgtgctatcgatgaccctgctcttcagcagcagccaagcatgaagaagctgtagacgaatttccgttgtcagacagacagtatggtggtgcttcatccactgaagtgctacaattaacttatggagattgctatagttacttcggtattttggagcgaggctgatgaactcgcctactatggcacttagtagtagcagcagcagtagtatgtttttgtttcccatttattcacccccggtgtttttgaatggaaacttgtatcctagtgatttcttcagagcagctgttaactgctctggccgattcaaagaaaaaaaaaaaaaaaaa

SEQ ID NO: 375 - protein, 508 aa, Zea mays
  misc_feature: Ceres CLONE ID no.1584568
  misc_feature: Bit score of 175.9 for HMM based on sequences of FIGURE 11.
  misc_feature (74)..(239): Pfam Name: HSF_DNA-bind Pfam Description: HSF-type DNA-binding
  misc_feature: Functional Homolog Of Ceres LOCUS ID no. At2g26150 at SEQ ID NO. 364
MHRARPTAHANDPDAPYAAAVAMLLEPKLEDEELPLQQLASPGPFVSLDQLMPAVAVPAEPRPLEALLQGPQLPPFLSKTYDLVNEPALDGVISWGAAGNSFVVWDPSTFARDVLPHNFKHNNFSSFVRQLNTYGFRKVHADRWEFAHEDFLRDSKHLLKRIVRRRSSPTKQSSVQPGSSSGESSLDPELHTLRREKNALLEEVARLKQEHRQTIEQMSTLNHRLESAEDRQRQMVSFLAKLLQNPSFVRKLKLHREKKEIDSTRVKRKFLKHVPHGSVESGESSSQHAGENGSYFAVSSPMATTTSVHDDITELQNFLLEDDDLNFGMDSENTGLEGTEATDDIGELIQGFDTQEELDLGSGAELQEMPPASGPLARDPTIGRFKGKNVLCPGLDATSSEGDCLSPLPDNMGLLSGTMLGTAGSMMAADDEQIWGVDASAALQSSCSGTSQQAFGSHASDPYLMDIANRPERFWELDFQALDEADLQLDKCAIDDPALQQQPSMKKL

SEQ ID NO: 376 - DNA, 1618 bp, Zea mays
  misc_feature: Ceres CLONE ID no.286056
  misc_feature: Encodes the peptide sequence at SEQ ID NO 377
aaaaaacaccaacccacccaccagcctattatactcaacgcgacgaactcatctcaccaccgcgccctccgccggatggagcggccagacgtgacggtcaagcaggaggaagacgaagtggtggtggtgttggacgccgacggcgatgcttgcgggcactggccgggagcccgcgcggcgccggagccttggcagacgccggtgggatccgcggttccgccgttccttgcgaagacgttcgagcttgtggaggacccggcgacggacgccgtgatatcgtggggcgccgcgcggaacagcttcgtggtgtgggatccacacgccttcgcggcggggcaccttccgcgccgcttcaagcacggcaacttctccaccttcctccggcagctgaacacctacgtccgtaatcacatatctcaattcgtaattaacaaacattgcaatggattccgcaaggtgagcccggacaggtgggagttcgcgcacgccgacttcctcgcggggcagcggcacctcctcgtgaacatccggcggcgccgcgggggcgtcgcgggacccacagcatctccgtcttcggcgggagccggcggcgaccgtgatagcgagctcgagaggctgcggcgggaccgggaggcgctggcgagggagctgacgcggctgcggcgcgagcaggaggaggcccgcgcgcagctgctggacatggagcggcgcgtgcggggcacggagcggcggcaggagcagtgcaccgccttcctggcgcgcgccatccggaacccgaccttcctggacggcctgctggcgcgccgctgtggcgcgcacgtagaggccggcaggaagcggcggctgctcgatgccgctgcggccggccctgacccagcggacgtcctcgacatcgaggagctggcgatggttgcgggcgccgaggtcggtgtggcttccatcccagccgttgcagcggcgcagatttccaacacagccaacgccacggacatgatatggtacgagcttctcggggaggagcaggtggagatcgacgccgaggtgcacgacctcgtcgtggccgccgcggctgccactgatgagttggcgcagccgtgggcggagatggacgagaaagaggttgcggagcttgtgcggcagatagactgccttgcctcgccgagtccctgatcagtgatcaccacgaggtggagaccgtgcagctagttgcacctgtaatatggtgctccctacggagagcaactacctaccactagtccactattagccatgcattgcctgtgtcactggcaatgccattggcatatgacggctgctgaagtacaatggtggcgctggtactgtggtacggtactgcagtgcgccacgctctggattggaccctaatggtcatttggtgtgtagtgtcgttagccttgctgtttgattgtggttattggattattaggtctgcgatatgctaatttggattctgcatctgttttgtgggatccgacagtggcggtatgctgcacacaaaccggccgtggtgatggatgcagcagcctgatccagttagttgatgtattcttaagaatttgaccaaagagcaactctaaccaagccttaaatttttgcc

SEQ ID NO: 377 - protein, 364 aa, Zea mays
  misc_feature: Ceres CLONE ID no.286056
  misc_feature: Bit score of 171.8 for HMM based on sequences of FIGURE 11.
  misc_feature (48)..(205): Pfam Name: HSF_DNA-bind Pfam Description: HSF-type DNA-binding
  misc_feature: Functional Homolog Of Ceres LOCUS ID no. At2g26150 at SEQ ID NO. 364
MERPDVTVKQEEDEVVVVLDADGDACGHWPGARAAPEPWQTPVGSAVPPFLAKTFELVEDPATDAVISWGAARNSFVVWDPHAFAAGHLPRRFKHGNFSTFLRQLNTYVRNHISQFVINKHCNGFRKVSPDRWEFAHADFLAGQRHLLVNIRRRRGGVAGPTASPSSAGAGGDRDSELERLRRDREALARELTRLRREQEEARAQLLDMERRVRGTERRQEQCTAFLARAIRNPTFLDGLLARRCGAHVEAGRKRRLLDAAAAGPDPADVLDIEELAMVAGAEVGVASIPAVAAAQISNTANATDMIWYELLGEEQVEIDAEVHDLVVAAAAATDELAQPWAEMDEKEVAELVRQIDCLASPSP

SEQ ID NO: 378 - DNA, 1299 bp, Populus balsamifera subsp. trichocarpa
  misc_feature: Ceres ANNOT ID no.1543432
  misc_feature: Encodes the peptide sequence at SEQ ID NO 379
atggaagcgggatcatcgccatccgccgccgccggcggaggaccggcgccgttcttgataaagacatatgacatggtggatgattcatcgactgacgagattgtgtcttggagttcgaacaaaaacagctttgtcgtatggaaccctccagaattcgccagattgttgcttcctacctttttcaagcacaataatttctctagctttatcagacaattaaatacctatggatttagaaagattgatcctgagaaatgggaatttgccaatgaagattttttgaaagatcagaagcatctgcttaagaacatccacagaagaaaaccaatccacagtcacagcaaccctcaaggttctttagtggatcaagaaagagcagcatatgaggaagaaatagacaagctttcacgtgataaagccaaactcgaggcaagtattctagggttttcacagcagcggtcatctgcaaagcttcatgtggaagatctaacacagaggatagatactatgcagcagaggcaggaaaagttgctgtcgttcttagagaaggctgttcaaaaccctgcttttgttgaacatcttgcttgtaagattgaatctatggatttttcagcatatagcaagaagagacgactgcctcaagttgatcactcaatgccaactgcagaaaatagttttgtcgaaaatcactgtagttctaggcctgagtctaatgtcatccatcaagatttctcaaataagttgaggctggaattatcaccagctgtttcagatattaatttgatttcacgtagtacgcagagctccaatgaagacgggggaagcccacaaaggaaaatatctgaagggaatccaaaagatggacctactaggacatcaggtttactattggcacctgaaacattggaactttcggatactgggacatcgtatacatttaaagtgaatcctgctgtcccaagagacttaccagcaagtgggagccaagcacaacattcactgcaggcgaatttgacttccaatgaagaagttgatggccttatttcctgtcaattgaacctaactctggcatcttctgcattgcaagagatcccaaataacagtcaagtgcctgcatcagctccagctagagtcaatgatggtttctgggaacagttcctaactgaaagaccgggctcttatgaaaatgaagaggcaagttctaattaccgagcaaactcttatgatgagcaggatgaaagaaggttaggtttcggagtgccaagaaatgctaaaaacatggagcagctctctctatga

SEQ ID NO: 379 - protein, 432 aa, Populus balsamifera subsp. trichocarpa
  misc_feature: Ceres ANNOT ID no.1543432
  misc_feature: Bit score of 145.9 for HMM based on sequences of FIGURE 11.
  misc_feature (15)..(109): Pfam Name: HSF_DNA-bind Pfam Description: HSF-type DNA-binding
  misc_feature: Functional Homolog Of Ceres LOCUS ID no. At2g26150 at SEQ ID NO. 364
MEAGSSPSAAAGGGPAPFLIKTYDMVDDSSTDEIVSWSSNKNSFVVWNPPEFARLLLPTFFKHNNFSSFIRQLNTYGFRKIDPEKWEFANEDFLKDQKHLLKNIHRRKPIHSHSNPQGSLVDQERAAYEEEIDKLSRDKAKLEASILGFSQQRSSAKLHVEDLTQRIDTMQQRQEKLLSFLEKAVQNPAFVEHLACKIESMDFSAYSKKRRLPQVDHSMPTAENSFVENHCSSRPESNVIHQDFSNKLRLELSPAVSDINLISRSTQSSNEDGGSPQRKISEGNPKDGPTRTSGLLLAPETLELSDTGTSYTFKVNPAVPRDLPASGSQAQHSLQANLTSNEEVDGLISCQLNLTLASSALQEIPNNSQVPASAPARVNDGFWEQFLTERPGSYENEEASSNYRANSYDEQDERRLGFGVPRNAKNMEQLSL

SEQ ID NO: 380 - DNA, 1647 bp, Panicum virgatum
  misc_feature: Ceres CLONE ID no.1728062
  misc_feature: Encodes the peptide sequence at SEQ ID NO 381
gtccctccggccctcccctaccaaactcccctctctctcgccgcgcaacagcaccaccacgcgctgccgaatcgctgtgtcatggaggtcgccggcgcccgcgggtccggcggcggcggcggcggcggaccggcgccgttcctgctgaagacgtacgagatggtggacgacccgtccagcgacgcggtggtgtcgtggagcgacgcctctgacgggagcttcgtggtctggaacccgcccgagttcgcggcccggatgctgcccacctacttcaagcacagcaacttctccagcttcatccgccagctcaacacctacggatttcgcaaaattgacccggagcgctgggaatttgctaatgagtactttgtcaagggacagcagcacctgctgaagaatatccacaggcgaaagcccatccacagccacagccatcaacctggtgccctgcctgacaatgagcgtgcattatttgaggatgagattgaccggctttcacaggagaaagctgcccttcaggctgacctctggaagttcaatgagcagcagtcgggggccgtgagccagattgaatatcttgagcagcgggtgctcgacatggagcaacggcaggtcaagatgctcagcttcctgcagcaggctagcaagaaccctcagtttgtcagcaagctcgctaagatggcagagacctccccaatcttcgcagacgcatttcacaagaagcgaaggctacctgggttggaatgcagcgccgaggccgctgaaactaccagtagcttttatgatgaccacagcagcacctccaggcaagaaatgggcaacgctttgaaccagcacttctccgacaagctgaagctggggctctgtcctgcgatgaccgagagcaacctcacccaaagctcgcacgaagataacgggagtcctcacgggaagcatccaaattgcgagagaccgggcgtggagtgcctcccgctagttccacagatgatggagctctctgacactgggacatccatctgcccctcgaaagggcagagcgtgagcttcgccgcagccgcgaacaacgacgggctcctgccgtgccacctcaacctcaccctcgcgtcgtgctccatggacgtcaacagaagccaaacctccgacgcgaatgtgaacgctatggaagaggaggacagcccagcggaggcgaccactacagccaccatggaggaagacgacggcatcggcacacgccagggtgatacgcagcacaaggtttcaggcgactcagccactgcagtagtggacccgacggtgccgccacatggggacagccagcaagctccccctccacacgaagaagctgcagctccccctgttgtggcgaacgacaagttctgggagcagttcctgacggagaggccggggtgcacggaagccgaggaagcaagctccacgctgaggagggaagatccgtaccaggacacgaggagtgacaggagagagatgggtcagctgaagctctgaccttcaggttagcatgaccactatgcatacagcatacgtacagtgtttgttataagggaatatatctagtgcaaaccaatgacctcgtacaaattcgtgcaaatctactaaacaaagctttaaaaaaaaaaaaaaaaaaaa

SEQ ID NO: 381 - protein, 474 aa, Panicum virgatum
  misc_feature: Ceres CLONE ID no.1728062
  misc_feature: Bit score of 162.5 for HMM based on sequences of FIGURE 11.
  misc_feature (17)..(184): Pfam Name: HSF_DNA-bind Pfam Description: HSF-type DNA-binding
  misc_feature: Functional Homolog Of Ceres LOCUS ID no. At2g26150 at SEQ ID NO. 364
MEVAGARGSGGGGGGGPAPFLLKTYEMVDDPSSDAVVSWSDASDGSFVVWNPPEFAARMLPTYFKHSNFSSFIRQLNTYGFRKIDPERWEFANEYFVKGQQHLLKNIHRRKPIHSHSHQPGALPDNERALFEDEIDRLSQEKAALQADLWKFNEQQSGAVSQIEYLEQRVLDMEQRQVKMLSFLQQASKNPQFVSKLAKMAETSPIFADAFHKKRRLPGLECSAEAAETTSSFYDDHSSTSRQEMGNALNQHFSDKLKLGLCPAMTESNLTQSSHEDNGSPHGKHPNCERPGVECLPLVPQMMELSDTGTSICPSKGQSVSFAAAANNDGLLPCHLNLTLASCSMDVNRSQTSDANVNAMEEEDSPAEATTTATMEEDDGIGTRQGDTQHKVSGDSATAVVDPTVPPHGDSQQAPPPHEEAAAPPVVANDKFWEQFLTERPGCTEAEEASSTLRREDPYQDTRSDRREMGQLKL

SEQ ID NO: 382 - DNA, 1224 bp, Populus balsamifera subsp. trichocarpa
  misc_feature: Ceres ANNOT ID no.1448950
  misc_feature: Encodes the peptide sequence at SEQ ID NO 383
atggatgaatcacagggcagtccgaactcgctgccgccttttcttgcaaagacgtatgagatggtggatgatccttcgacggatccaattgtttcttggagtcagagcaataagagttttactgtatgggatccaccggagtttgccagggatttgctgcccagattttttaagcataataacttctctagcttcatcagacagctcaatacttatggttttaggaaaattgatcccgagcaatgggaatttgctaatgaagattttataagaggtcaaccatttctaatgaagaacatccatagacggaagccagttcatagccattcgttgcagaatcttcaaggacaaggctctaatctgctgactgattcagaaagacagagtatgaaggatgatatagagaggcttaaacgtgataaagaagcacttattttggagttacaaatgcaggaacaagagcggaaaggatttgagatgcaaattgagggtttgaaagagaagttgcaacaaatggaacgaagacaacaaactatggtatcttttgtgacccgagtgatgcctaaaccaggtcttgccttaaatctaatgccgcagttggaaggtcatgatagaaagagaaggctgccgagaattggttgtctacacagtgaagccagtagtaatgaggataatcagacggtgacttcccaagctctgtctagagaaaatgcagatggtaattcttttgccctgttaaacatggagcagtttgatcagttggaatcatccctgacattctgggagaatatggtaaatgatgttgttcaaacccacagtcataacactaaaacgatagagatggatgagtctacaagtggtgcagaaagtccagctatatcttgtgcacagctcatttttgattttcgccctaaaacacctggtattgacatgaattctgaaccttctatagctgttgtgccagagcctgtttcaccgaaggaacaacctgctgggactgctcccgctgtggcaactggagtcaacgatgtattctgggaacagtttttaactgagaatcctggttcaactgacacacaggaagttcaatctgaaagaaaggattctgatggtagaaaaaatgaaataaaacctggtgatcccagaaaattttggtgggatatgaggaatgtaaataatcttacagagcagatggggcatcttactcctgctgaaagaacttga

SEQ ID NO: 383 - protein, 407 aa, Populus balsamifera subsp. trichocarpa
  misc_feature: Ceres ANNOT ID no.1448950
  misc_feature: Bit score of 161.3 for HMM based on sequences of FIGURE 11.
  misc_feature (12)..(183): Pfam Name: HSF_DNA-bind Pfam Description: HSF-type DNA-binding
  misc_feature: Functional Homolog Of Ceres LOCUS ID no. At2g26150 at SEQ ID NO. 364
MDESQGSPNSLPPFLAKTYEMVDDPSTDPIVSWSQSNKSFTVWDPPEFARDLLPRFFKHNNFSSFIRQLNTYGFRKIDPEQWEFANEDFIRGQPFLMKNIHRRKPVHSHSLQNLQGQGSNLLTDSERQSMKDDIERLKRDKEALILELQMQEQERKGFEMQIEGLKEKLQQMERRQQTMVSFVTRVMPKPGLALNLMPQLEGHDRKRRLPRIGCLHSEASSNEDNQTVTSQALSRENADGNSFALLNMEQFDQLESSLTFWENMVNDVVQTHSHNTKTIEMDESTSGAESPAISCAQLIFDFRPKTPGIDMNSEPSIAVVPEPVSPKEQPAGTAPAVATGVNDVFWEQFLTENPGSTDTQEVQSERKDSDGRKNEIKPGDPRKFWWDMRNVNNLTEQMGHLTPAERT

SEQ ID NO: 384 - DNA, 1854 bp, Triticum aestivum
  misc_feature: Ceres CLONE ID no.771500
  misc_feature: Encodes the peptide sequence at SEQ ID NO 385
gcaccgcccattccggccatccgccagcgcgcggcgcatggaccacacgcacaccggcaccaacaccacgcccgccgcagtcatcgcctccgcctccatggacgccgcgctgctactcgagcccaagctcgagatgatgctgcagcagcagccctcgcctgcgggccactacgccgcgctggaccatcacctggtcccgccgccgcccgcgctggtggtgccctgcgagccgccgcggcccctcgaggcgctgctgcaggggccgcagctgccgccgttcctgtccaagacgtacaacctcgtcagcgagccgcagctggacggggtcatctcctggggccccgccggcaacagcttcgtcgtgtggaacccttccaccttcgcccgtgacgtgctcccgcacaacttcaagcacaacaacttctccagcttcgtcaggcagctcaacacctatggttttcgcaaggttcatgctgatagatgggagttcgctcacgagggatttctgcggggcagcaaacatctgttgaagacgatagtcaggcgccggtcctcgccgacgcaacaaagcagccttcagcctggttcatctatcttcaggaagatacagtctagctcttctggtgagtccactctggaccctgaactgcactccctgagaagagagaaaaacgcgctgctacaggaggtggccaggctgaaggaggagcacaatcagacgatcgagcatatgaacgcactgaaccagaggctggagaccgcggaggaccggcagaagcaggtggtctccttcttggccaagctccttcggaacccggatttcctgaggcagctcaagatgcacagggagagaagggacgggatcgattccgccagagtgaagaggaaattcctgaagcatgtgctgcatggcagcagaaactcgggcgactccaactcgccgcgcaccgcagagagtacatgttcccctgcacatccagttgcgcacgacgccattgcagacctacagagttttctcctggaagacacggaccttagtgatggcatgctgccgggtaactttgggctggacggagtcgaagcatcagacgacatcggggctttggttcaggtatttgaccagcaagatctcggaaccggggccgagctgcttggaattcctccagttcctggtgctgctcattgtcaagaccccacgtttggcaggtccaaggggaagaatgtcatgtgtccaggaggaacggatggcacatcgtctcaagccgactgcctcgtgccattaccgggcaacgtgggcaaactgatggatgcggatggtgagcaaatttggggcgccaatactttttttcagagttcttgcagcggcaccagtcaacaaacctatgttagtgatccctatctaatggagattcccgacaagcctgagagattctgggaactcgattttgatgcactggatgatggagatctgcacctggacaagtgtgttatcggcgaccctgctcttgagcaacacagaggaaacatgaagccatagatcaattgcgaagcgggggagttgtaggtctgatgctcgatccacctatcttaataaccatacttagctgtgagaagtgccatagttatttgatatttaggaggctagtgaactcctggatgtgctcactatggcactaagaattagtagtagtggtggtactagtactagcggtttgtttttgttttccattcattcaccctactgtttttgaatggaaaatattatcatgtcatttgctttgtttttgttttccattcattcaccctaccctttttgaatggaaaaatatcattgtgtgaaaaaaaaaaaaaaaa

SEQ ID NO: 385 - protein, 499 aa, Triticum aestivum
  misc_feature: Ceres CLONE ID no.771500
  misc_feature: Bit score of 140.4 for HMM based on sequences of FIGURE 11.
  misc_feature (79)..(253): Pfam Name: HSF_DNA-bind Pfam Description: HSF-type DNA-binding
  misc_feature: Functional Homolog Of Ceres LOCUS ID no. At2g26150 at SEQ ID NO. 364
MDHTHTGTNTTPAAVIASASMDAALLLEPKLEMMLQQQPSPAGHYAALDHHLVPPPPALVVPCEPPRPLEALLQGPQLPPFLSKTYNLVSEPQLDGVISWGPAGNSFVVWNPSTFARDVLPHNFKHNNFSSFVRQLNTYGFRKVHADRWEFAHEGFLRGSKHLLKTIVRRRSSPTQQSSLQPGSSIFRKIQSSSSGESTLDPELHSLRREKNALLQEVARLKEEHNQTIEHMNALNQRLETAEDRQKQVVSFLAKLLRNPDFLRQLKMHRERRDGIDSARVKRKFLKHVLHGSRNSGDSNSPRTAESTCSPAHPVAHDAIADLQSFLLEDTDLSDGMLPGNFGLDGVEASDDIGALVQVFDQQDLGTGAELLGIPPVPGAAHCQDPTFGRSKGKNVMCPGGTDGTSSQADCLVPLPGNVGKLMDADGEQIWGANTFFQSSCSGTSQQTYVSDPYLMEIPDKPERFWELDFDALDDGDLHLDKCVIGDPALEQHRGNMKP

SEQ ID NO: 386 - DNA, 1572 bp, Populus balsamifera subsp. trichocarpa
  misc_feature: Ceres ANNOT ID no.1485096
  misc_feature: Encodes the peptide sequence at SEQ ID NO 387
atggattgtcaacagtcttctagtgcagggtcgatatttgttgaagatttaagcttccctgctgccgcaccttctcctttaatggacctggaggctttctcctatgtaagcccgacgacttcagctcatccagtatcatcatcggcgactgccaacgaggtggatgaggaagaggagatgccacgtcctcttgtgtgcttacaggagaatccagtaccgccttttctatcgaaaacatatgatctggtggatgatcggatgctggacccaataatttcgtggggttccattggggagagtttcgtggtgtgggaccccgaggagttcgccaggcttgttctccctcggaatttcaagcacaacaatttctccagttttgtccgacaactcaatacttatgtgggcagaaccagaataatagttagtgatgtaggattgttgtcttatgtaatatacaaggggttccgcaagattgatactgatcgatgggagtttgccaatgaatctttcagaagaggcgagaagcatctgttgaagaacattcataggcgcaaatcaacacagtcccagcaggttgggagccacacggggtctttaactgaagcagggaggtctggattggatagtgaggtagaaagattaaggaaggagcggagtgtgatgatgcaggaagttatagaactgcagaagcagcagtctgggactgttcacgatgtgcaatcagtaaatcagagacttcaggcagcagagcaaaggcagaagcagatggtttcgttcttggcaaagttgtttcagaatccagcattcttagcccgtctcaagcaaaagaagcaacagggagagattggttcatcaaggatgaagaggaagtttgttaagcaccagcaacaccaacatgccctacctgaatcatcaatggaagggcagattatgagatacatgcctgattggagaaacatcacattatcttctgtggtcccggatacaagtccagcctctattgatcaatctcctgattatctctcagaaggcatggtaggcctgggtcttggcagtgaagcaatgccattacctgaaattgttgcacctgatgaatttgccatctcagacgaattaggattgggacagggatttatcaaaacaccagagcaggttggagaagggcaatcaagcatgcaatttgaagatcccaagctcaaaggaaagattgatatgagcccgcaaaatgaggctggtcttgaatattttgtctcttttcctgaggatttggggatggagaaaagctttccagaattatcttcccctggcatggaaagaattgttaaacaagaggatgtatggagtttggcatttaacactagtgctggtatgtctagttctagcaatgttccatgggataattttttcggatatgatatgccagagttgggatcaacaggtggcttctcagatatctgggatataggttctggacaagcaggaggaggtttgagcatggataagtggctggctgatgaaagtcccgttgatgagtctgatagtcaagctggccagccaaaagatgataaataa

SEQ ID NO: 387 - protein, 523 aa, Populus balsamifera subsp. trichocarpa
  misc_feature: Ceres ANNOT ID no.1485096
  misc_feature: Bit score of 124.3 for HMM based on sequences of FIGURE 11.
  misc_feature (73)..(260): Pfam Name: HSF_DNA-bind Pfam Description: HSF-type DNA-binding
  misc_feature: Functional Homolog Of Ceres LOCUS ID no. At2g26150 at SEQ ID NO. 364
MDCQQSSSAGSIFVEDLSFPAAAPSPLMDLEAFSYVSPTTSAHPVSSSATANEVDEEEEMPRPLVCLQENPVPPFLSKTYDLVDDRMLDPIISWGSIGESFVVWDPEEFARLVLPRNFKHNNFSSFVRQLNTYVGRTRIIVSDVGLLSYVIYKGFRKIDTDRWEFANESFRRGEKHLLKNIHRRKSTQSQQVGSHTGSLTEAGRSGLDSEVERLRKERSVMMQEVIELQKQQSGTVHDVQSVNQRLQAAEQRQKQMVSFLAKLFQNPAFLARLKQKKQQGEIGSSRMKRKFVKHQQHQHALPESSMEGQIMRYMPDWRNITLSSVVPDTSPASIDQSPDYLSEGMVGLGLGSEAMPLPEIVAPDEFAISDELGLGQGFIKTPEQVGEGQSSMQFEDPKLKGKIDMSPQNEAGLEYFVSFPEDLGMEKSFPELSSPGMERIVKQEDVWSLAFNTSAGMSSSSNVPWDNFFGYDMPELGSTGGFSDIWDIGSGQAGGGLSMDKWLADESPVDESDSQAGQPKDDK

SEQ ID NO: 388 - DNA, 1655 bp, Glycine max
  misc_feature: Ceres CLONE ID no.1646104
  misc_feature: Encodes the peptide sequence at SEQ ID NO 389
attgagttcccctttgccaagtcttgtcttgtgtttgttgcagttgcggttgcggttgcgattgcgatggtgaaatcgaacgagaacggttctggttccgtttcggtgcctcctttcctgaaaaaatgttacgatatggtggaagaccgcaacactgattctatcatccgttggagcgatggcggtgacagctttgtcatctccgacatcactcaattctccgtcacgctccttcccacctatttcaaacacaacaatttctccagtttcatcagacaactcaatatctatggtttcaggaaaattgatacggattgctgggaatttgccaatgagaactttgttagaggtcaaaagcatttgttgaagaatatacgtagaaggaaacatccacacagtgcagatcagcaaaaagcattgccacagcaagacaattgtgatgaaccatcacaagaagcaccgtatcatggcctttggaaagaagttgagaatctaaaacttgataaaaattcgctcacgcaagaattggtcaaacttaggcaacaccaggaatctgctgagaataagttgctgctcctgagtgatcgccttcaaggaatggaaaagcatcagcagcagatgttatcatttttagtcatggttgtgcaaagccctgggttcatggttcagcttcttcatcctaaggaaaataattggcatttggctgaatcatggaatatattggatcaagataaacaagatgacaagccagttgcttctgatgggatgataataaagtataaaccacctgtaggtgaaaaactaaagcctgtagttcctctgtctcctggtttcgaaaagcaaacagaacccgagctttctgcagaagggctaaaagacttgtgcgtcagttctgaattcttgaaagtgcttctggatgaaaaattatctccattagaaaatcattctccatttctcctaccagatttacctgatgatggttcatgggaacagctttttctaggtagtcctttcatgggaaacattcaagattctaataaagaaagtgaggggcacaccaatggtggaatggagatggaaccaacaatatctgagactccaaatgaaaattctcgaacttttgaatcgatgattgtagagatggagaaaactcgagaatgagttggagttgtatgcacatggtgggctgtcttcttggaatccatcagatatttttcagctgggctgtctcatactgagctaatggagctttagtttctgaaactaacaatatatagggaaggaagtaataatgtccatcagatatttttcagctgggctgtcttcacagattacttcacactataattatattatagtattaagtcgcaattattttctctcccatcttccttcagcagttgttagatcctcttctagaatccatattttggcttcctgatacatggtgtcggagatcaggagttgtatggtagtgcacgagtgcggcgacctatatatatagcggatcaattatttcttttatggaaaattgtaagggaaaacggcaactttattttttgtgccacattaaacagtggcacttgctttcatatatattataaaatttcacgaaattcatgcttctcttgcaagaaaaaaaaaaaaaaaaaaaa

SEQ ID NO: 389 - protein, 364 aa, Glycine max
  misc_feature: Ceres CLONE ID no.1646104
  misc_feature: Bit score of 132.8 for HMM based on sequences of FIGURE 11.
  misc_feature (15)..(189): Pfam Name: HSF_DNA-bind Pfam Description: HSF-type DNA-binding
  misc_feature: Functional Homolog Of Ceres LOCUS ID no. At2g26150 at SEQ ID NO. 364
MVKSNENGSGSVSVPPFLKKCYDMVEDRNTDSIIRWSDGGDSFVISDITQFSVTLLPTYFKHNNFSSFIRQLNIYGFRKIDTDCWEFANENFVRGQKHLLKNIRRRKHPHSADQQKALPQQDNCDEPSQEAPYHGLWKEVENLKLDKNSLTQELVKLRQHQESAENKLLLLSDRLQGMEKHQQQMLSFLVMVVQSPGFMVQLLHPKENNWHLAESWNILDQDKQDDKPVASDGMIIKYKPPVGEKLKPVVPLSPGFEKQTEPELSAEGLKDLCVSSEFLKVLLDEKLSPLENHSPFLLPDLPDDGSWEQLFLGSPFMGNIQDSNKESEGHTNGGMEMEPTISETPNENSRTFESMIVEMEKTRE

SEQ ID NO: 390 - protein, 337 aa, Beta vulgaris
  misc_feature: Public GI ID no.111184724
  misc_feature: Bit score of 84.4 for HMM based on sequences of FIGURE 11.
  misc_feature (47)..(175): Pfam Name: HSF_DNA-bind Pfam Description: HSF-type DNA-binding
  misc_feature: Functional Homolog Of Ceres LOCUS ID no. At2g26150 at SEQ ID NO. 364
MEPKTELSLGGGIRSSGFVTTKMEDTEEKEVIELPKPLENLHEIGPPPFLSKTFEIVEDPETDTIVSWGVTFDSFIVWDISKFSDLLSKYFKHRNFNSFVRQLNTYGFRKVHLDRLEYANSGFQKGKKHLLKTIKRRNHGANNNTALLLQRETAIENIKKEQEALKLEILDLKKEQQNSNTCLAALGERVKFVEWKQREFIMLIAKAMKRTSSFQQVLQNYRHNKVLSSGEFYKKRRLASTSDSLALADQFLANSPTTTQNKEDVSTFQYEANSFVGSAGQKSNLASETSSPDLSSGSYIMWEKLMADDVICKDDREEKYVHELENLITKPSSLICK

SEQ ID NO: 391 - DNA, 1197 bp, Glycine max
  misc_feature: Ceres CLONE ID no.1362475
  misc_feature: Encodes the peptide sequence at SEQ ID NO 392
aaaaaaaaaataacctcacacactttctctctctctctttctctttctcactcactctcactctctgtcacggacagacagagaaaaactcagacacccacgttcacacttccctcacaccatcccttactgttccttcttcttcttcttccttttttttttttctcttaatggaatgatggaacacaacatcatcgttaacaacaacaacgtgatcgcaccgtttgtcataaaaacctataacatggtgaacgatcccaccaccgataaactcatcatgtggggcccagccaacaacagcttcatcgtcctcgaccccctcgacttctctcactccctcctccctgctttcttcaagcacaacaacttctccagcttcgttcgacaactcaacacttatggtttcagaaaggtggatccggatcggtgggaattcgcaaatgagtggttcctgcgaggacagaagcacttgttgagaaacatcgcgcggaggaagcacggtggagctgggaggagcaatttcaatttgcattcgcatcatcatccgttgaaggtggaggaattggacgacgaagccatggtgatggagatagcgaggttgaaggaggagcaaaaagcgttggaggaagagcttcaaggaatgaacaagaggttagagacaacagaaaaacgaccacaacaaatgatggcttttctgtccaaggttgtcgaggacccgcaggttctttctcggattctccgagaaagagaaaagaaacacctgggcgagaaaaagcgccgcctaattccgccgccaacaacgacggcagcgacgacgtcgtcgtcgtcgtcctccggcatcaagacggagttcgaagaagacgaaggtaattataatatcatgtcttcgtcgccggagacagggttggaaatcgataataataatatttgttcgcctctggcggcggggtattggggggaacagggttgtcatgggtacaatcgtggcgccgtgacggcgccgttgacggtggtggcgccggcggttccgacgatgggaggagggtatttggggcgtggggttttttttggggaaatggcggcggaggggaatgcggtgccgccttatccgttttcgttgttggaaggtggcttttagatttatttgttttaggttatgaaatgaatgaattattactgccaaaaaaaaaaaaaaaa

SEQ ID NO: 392 - protein, 320 aa, Glycine max
  misc_feature: Ceres CLONE ID no.1362475
  misc_feature: Bit score of 93.2 for HMM based on sequences of FIGURE 11.
  misc_feature (15)..(107): Pfam Name: HSF_DNA-bind Pfam Description: HSF-type DNA-binding
  misc_feature: Functional Homolog Of Ceres LOCUS ID no. At2g26150 at SEQ ID NO. 364
MMEHNIIVNNNNVIAPFVIKTYNMVNDPTTDKLIMWGPANNSFIVLDPLDFSHSLLPAFFKHNNFSSFVRQLNTYGFRKVDPDRWEFANEWFLRGQKHLLRNIARRKHGGAGRSNFNLHSHHHPLKVEELDDEAMVMEIARLKEEQKALEEELQGMNKRLETTEKRPQQMMAFLSKVVEDPQVLSRILREREKKHLGEKKRRLIPPPTTTAATTSSSSSSGIKTEFEEDEGNYNIMSSSPETGLEIDNNNICSPLAAGYWGEQGCHGYNRGAVTAPLTVVAPAVPTMGGGYLGRGVFFGEMAAEGNAVPPYPFSLLEGGF

SEQ ID NO: 393 - DNA, 1366 bp, Glycine max
  misc_feature: Ceres CLONE ID no.597906
  misc_feature: Encodes the peptide sequence at SEQ ID NO 394
aaaaaaattttaacctcaccctctttacccacaccctctctctctctctctctgtcacgcacagagaaaaactcagacacccacgttcacacttcgcacacaccatctctcactgttctttcttcttcctctttttcttttttttttttcttttctcttaatggaatgatggaacacaacatcatcgtcaacaacaacgtgatcgcaccgtttgtcataaaaacctacaatatggtgaacgatcccaccaccgataaactcatcacgtggggcccagccaacaacagcttcatcgtcctcgatcccctcgacttctcccactccctcctccctactttcttcaagcacaacaacttctccagcttcgttcgccaactcaacacctatggtttcagaaaggtggatccggatcggtgggagttcgcgaacgagtggttcctgcgaggacaaaagcacttattgaggaacatcgtgcggaagaagcacggtggagctgggaggaccaattccaattcgcattattcgcatcccttgaagctggaggagttggacgacgaggctatggtgatggagatagcgaggttgaaggaggagcaaaaagcgttggaggaagagcttcatgaaatgaacaagaggttagagacaacagaaaaacgaccacaacaaatgatggcttttctgtgtaaggttgtcgaggacccgcagattctttctcggattctccgagaaagagaaaagaaacacctgggagagaaaaagcgacgcctcattccgcctccgccgccgacggcagcgacgtcgtcgtcgtcgtcctccggcatcaagacagagttcgaagaagacgaaggtaattataatatcaagtcttcgtcgccggagacagggttggaaatcgacaacaatagtaacaatatttgttcgccgccgccgctggggtgttggggtgaacagggttgttatgggtacaattgcgcctccgtgccggcacctttgacggtggtagcgccggcgtttccgacgatgggaggagggtatttgaggcgtggggggttttggggggaaatggcggcggaggggaatgcggtgccgccttatccgttttcgttgttggaagggggcttttagatttagttttaggttatgaaatgaatgaattattactgccacaaaatttcatcttggattttctgtcgtattgaaagttctatccttttttgtgcgttgattctgtgtaaagaaaaaaggttgggaaaaagagtaaaaaggtagtgggaaaattgttagatatttatagttgtgttcggtttcaggttttttttttcataaatattgtttttaaataaatgctttgcggatggtgtagacc

SEQ ID NO: 394 - protein, 319 aa, Glycine max
  misc_feature: Ceres CLONE ID no.597906
  misc_feature: Bit score of 77.5 for HMM based on sequences of FIGURE 11.
  misc_feature (14)..(106): Pfam Name: HSF_DNA-bind Pfam Description: HSF-type DNA-binding
  misc_feature: Functional Homolog Of Ceres LOCUS ID no. At2g26150 at SEQ ID NO. 364
MMEHNIIVNNNVIAPFVIKTYNMVNDPTTDKLITWGPANNSFIVLDPLDFSHSLLPTFFKHNNFSSFVRQLNTYGFRKVDPDRWEFANEWFLRGQKHLLRNIVRKKHGGAGRTNSNSHYSHPLKLEELDDEAMVMEIARLKEEQKALEEELHEMNKRLETTEKRPQQMMAFLCKVVEDPQILSRILREREKKHLGEKKRRLIPPPPPTAATSSSSSSGIKTEFEEDEGNYNIKSSSPETGLEIDNNSNNICSPPPLGCWGEQGCYGYNCASVPAPLTVVAPAFPTMGGGYLRRGGFWGEMAAEGNAVPPYPFSLLEGGF

SEQ ID NO: 395 - DNA, 1627 bp, Triticum aestivum
  misc_feature: Ceres CLONE ID no.615781
  misc_feature: Encodes the peptide sequence at SEQ ID NO 396
aagaaattctcgccccccaacccaacccccaaccaaccaaccaaacccaaccgaagaagccgagccgaaccccactccgccgatcagccgctatgcgctgaggccgaatcgccgcagcccgaggaggagaagggggtggaggggatggaggggagtggcgggtccgcgtcgctgccgccgttcctcaccaagacgtacgagatggtggacgagccggccacggacgcggtggtggcgtggacgccgtccggcaccagcttcgtcgtcctcagccaggccgacttctgccgggatcttctccccaagtacttcaagcacaacaacttctccagcttcgtgcgccagctcaacacctacggctttaggaaggtagatccagaacaatgggaatttgcaaatgaagaattcctacgagatcagcggcatcggttgaaaaatatccatagacgcaagccaatattcagccattcatcacacactcagggtgccggaccattagctgatagtgaaaggagggactatgaggaggaaattgagaggctcaagtgtgataatgcatcactaaatttacagcttgagaggaagaaaactgatatggagagtaaaatgaaggctttggaagacaaactatttgctattgaggatcagcagaaaaatcttatatcttatgtcagagaaattgtgaatgcacctggatttctttctagcttcgtagaacaatctgatcatcatggaaagaagaggagactgcctaaaccaatttcattccatgatgatgcttgtactcaggggaaccagattatgcattgtgacttggtcaactcaccagctcatgaactttttaggtcatcatttgacaaaatggaatcatccttaaattccttggagaatttcttcaaagaagcgagtgaggcatttggtaatgatgtttcatctgatggtgatgtcccaggtcattcttcagctgttgttcttacagagctccattcaactggggagagtgacccccacgcgcaatcacctccgtccatgatgcatacttgttcagctggtgtaggagattcacactcttctcgtgatatagcagagtccgccagctgtccagagagtcctctgcttccccaagctcattctcgtgcagattcacgagctaaggtctccgagatagatgtcaatttagaacctgctgttacagaaaatggtccatcgagagatcaacaacccacccaagaccttcctgctgacgcaaatgatggattttggcagcagtttcttaccgagcagcctgggttgacccatgcacaccaggaggcccaatcagaacggcgagacagagaagcaaatcaaacaacagcaggagaccgcggaagtttttggttggacaagagcagcatcgaacagatgacaaaaaaactggggcatctcacctcagctgagaaaacctgagtatgtatttctcatttcttgtagctgaaaatgaccagtacagaaacattaggaccatggcacctcccagtgaggtatgcctgctaacatttactttgcagtgtatcagaattgtgtgtgttagattgttgcagactatgtgctatatactaccttgatatacgttcatactttgttagcg

SEQ ID NO: 396 - protein, 433 aa, Triticum aestivum
  misc_feature: Ceres CLONE ID no.615781
  misc_feature: Bit score of 92.5 for HMM based on sequences of FIGURE 11.
  misc_feature (11)..(104): Pfam Name: HSF_DNA-bind Pfam Description: HSF-type DNA-binding
  misc_feature: Functional Homolog Of Ceres LOCUS ID no. At2g26150 at SEQ ID NO. 364
MEGSGGSASLPPFLTKTYEMVDEPATDAVVAWTPSGTSFVVLSQADFCRDLLPKYFKHNNFSSFVRQLNTYGFRKVDPEQWEFANEEFLRDQRHRLKNIHRRKPIFSHSSHTQGAGPLADSERRDYEEEIERLKCDNASLNLQLERKKTDMESKMKALEDKLFAIEDQQKNLISYVREIVNAPGFLSSFVEQSDHHGKKRRLPKPISFHDDACTQGNQIMHCDLVNSPAHELFRSSFDKMESSLNSLENFFKEASEAFGNDVSSDGDVPGHSSAVVLTELHSTGESDPHAQSPPSMMHTCSAGVGDSHSSRDIAESASCPESPLLPQAHSRADSRAKVSEIDVNLEPAVTENGPSRDQQPTQDLPADANDGFWQQFLTEQPGLTHAHQEAQSERRDREANQTTAGDRGSFWLDKSSIEQMTKKLGHLTSAEKT

SEQ ID NO: 397 - DNA, 1454 bp, Glycine max
  misc_feature: Ceres CLONE ID no.538713
  misc_feature: Encodes the peptide sequence at SEQ ID NO 398
gaagcattctcaaccatgaactcgtctccgtcttcttcccagttaccttcatcaagcgctgattttgacaagtttaatagtttgccgcgcttccgcccacttgaatgcttgcaagggaacccggttccggcgttcctgtccaagactttcgaactcgtcgacgatccctcgctggatccgatcatatcctggggctccaccggtgttagcttcgtggtgtgggatcctaccctgtttgcaagacacgtcttgccgaggaatttcaagcataacaatttctccagttttgttcgccagttaaatacctatggattccgcaagattgacactgaaaaatgggagtttttcaatgaagctttccagcgaggaaagagacatcttctgaagaacatccggaggcgcgggccacctcagtcccatcaggttggtggcaatattgtgccttattccgatgcagataaggccgggcttgaatttgagctagaaagtctaaggaaagaaaggagtgtgctaatgcaagaggtggttgagttgcaacaacagcagagaacgacacttcaacgtgcgagacaggtgaatcagaggcttcaatctgcagaactgatacagaaacaaatggtttctttcttggcaaggttatttgaaaagccagcatttttaaccagtcttcagcatgcgaaggaacaaagagatttagggtgtcctaaagttagaaggagatttatcaaccagcaccaaggccaaacagaaatatcagattttttaaatgaagggcagattgtaagataccaacctgattggagaaatgtaaccacctcttctgaaatacaagaaatgtatccagtttcacttgaagagtctccaaattacctttctcaggctttggcaaaagaatttagtgaaggcacagagaatctgatatcagatgaagtcatgtcaattgctgacaccatggggtttaagtcatcaagctttggacttgatggtaaccttttcaaagggaaaaatgtcatgagctcaaacgaaggtcttcttgcagaggagtttgtgtctttcccagaggatttgaccaaggagacaggatttccagagttttcacctcttggaactgaaggcatcatcaagcgagaagataaacggaacaccaactttgatgttagtggtgctgattcaagctctgggaatgaacagtggggaaatcctatcaattatgaagtgccagaatttgtagtcacaagtggtatgacagacatgtgggatattaactatttaactcacagcaagtgacagaaagtatcccaatacatgattcaacccttgatgaaaaagaaagataatataaataagaatatggatgcatcgggcttcatctgcttctgcacatattgtgctgtgtttagttcccaggggtccaattattaaataaattgatttgtaactggtgctcattcact

SEQ ID NO: 398 - protein, 423 aa, Glycine max
  misc_feature: Ceres CLONE ID no.538713
  misc_feature: Bit score of 110.4 for HMM based on sequences of FIGURE 11.
  misc_feature (38)..(205): Pfam Name: HSF_DNA-bind Pfam Description: HSF-type DNA-binding
  misc_feature: Functional Homolog Of Ceres LOCUS ID no. At2g26150 at SEQ ID NO. 364
MNSSPSSSQLPSSSADFDKFNSLPRFRPLECLQGNPVPAFLSKTFELVDDPSLDPIISWGSTGVSFVVWDPTLFARHVLPRNFKHNNFSSFVRQLNTYGFRKIDTEKWEFFNEAFQRGKRHLLKNIRRRGPPQSHQVGGNIVPYSDADKAGLEFELESLRKERSVLMQEVVELQQQQRTTLQRARQVNQRLQSAELIQKQMVSFLARLFEKPAFLTSLQHAKEQRDLGCPKVRRRFINQHQGQTEISDFLNEGQIVRYQPDWRNVTTSSEIQEMYPVSLEESPNYLSQALAKEFSEGTENLISDEVMSIADTMGFKSSSFGLDGNLFKGKNVMSSNEGLLAEEFVSFPEDLTKETGFPEFSPLGTEGIIKREDKRNTNFDVSGADSSSGNEQWGNPINYEVPEFVVTSGMTDMWDINYLTHSK

SEQ ID NO: 399 - DNA, 1256 bp, Gossypium hirsutum
  misc_feature: Ceres CLONE ID no.1794141
  misc_feature: Encodes the peptide sequence at SEQ ID NO 400
agctcagaaagaaggaaaccttttctccagcagagaaacaaagggtcagtttctatctttttgatgaaatggaggctgacagtaatcctaaaatagttgcgccattcgttgcgaaaacttaccagatggttaatgatcccatgactgacggtttgatcacatggggtaaagctaataacagtttcatagtcatcgaccctttagatttctctcaaaggatcttgcctgtttacttcaagcatagcaatttttctagcttcgttcgccagcttaatacttatggtttcaagaaggtggatcccgataagtgggaatttgcgaatgagtggttcctgcgagggcaaaagcatttgttgaagaacatagcgagaagaaagcataataaaaatccattcatgcaactgaaagctgaggacttagaggacgaagaaatagtgatggaaatagcgagactaaaagaggagcaaaagtcgttggaagaagagctgcaagggatgaacaagcgtttagaagccactgagagacgcccgcaacaaatgatggagtttctttacaaagtcgttgaagaccctgacctccttcctcgtatgatgctcgaaaaggaacggacaagacaacttaacgccgacaagaagcgacggttgacgatgatgccctccaactcatcatcttcaagcctggccgtttctaataattcagtcaagtccgaagaggaagaagatggacatccaggagtaatttcgtccccagaaactggattcgatatggaaaacaacttttatcgctcaagttatcaatcatcgccgtcgcctgatcaggactcaaaagaattgttggggcaaaatagactacatgaggggcaactcatgaactatggttgcgccgcagtaacaactcaattgccggcggtgatggtggctccgacggtgattgggaacggcatggcggtgtcttcgtcggggacgactagtgtagcagggtatggtgataggagcgggcaactgggttatttcggagaaatggcggcgccttggatggaggcgcgtccacgaccgccttatccattttcgctattagagggtggcttttagttggttgcgtcacatgatatatcttggattctatcttactacggattttttttttaaagttttagattttgcaaatttcatttcatatatcggcttttgtaaataaaatgatttaattataaggttaacaaaaatcttattttataaaaaaaaaaaaaaaaaaaa

SEQ ID NO: 400 - protein, 340 aa, Gossypium hirsutum
  misc_feature: Ceres CLONE ID no.1794141
  misc_feature: Bit score of 98.3 for HMM based on sequences of FIGURE 11.
  misc_feature (11)..(107): Pfam Name: HSF_DNA-bind Pfam Description: HSF-type DNA-binding
  misc_feature: Functional Homolog Of Ceres LOCUS ID no. At2g26150 at SEQ ID NO. 364
MEADSNPKIVAPFVAKTYQMVNDPMTDGLITWGKANNSFIVIDPLDFSQRILPVYFKHSNFSSFVRQLNTYGFKKVDPDKWEFANEWFLRGQKHLLKNIARRKHNKNPFMQLKAEDLEDEEIVMEIARLKEEQKSLEEELQGMNKRLEATERRPQQMMEFLYKVVEDPDLLPRMMLEKERTRQLNADKKRRLTMMPSNSSSSSLAVSNNSVKSEEEEDGHPGVISSPETGFDMENNFYRSSYQSSPSPDQDSKELLGQNRLHEGQLMNYGCAAVTTQLPAVMVAPTVIGNGMAVSSSGTTSVAGYGDRSGQLGYFGEMAAPWMEARPRPPYPFSLLEGGF

SEQ ID NO: 401 - protein, 408 aa, Nicotiana tabacum
  misc_feature: Public GI ID no.5821138
  misc_feature: Bit score of 118.7 for HMM based on sequences of FIGURE 11.
  misc_feature (12)..(183): Pfam Name: HSF_DNA-bind Pfam Description: HSF-type DNA-binding
  misc_feature: Functional Homolog Of Ceres LOCUS ID no. At2g26150 at SEQ ID NO. 364
MDEATCSTNALPPFLTKTYEMVDDPSSDAIVSWSSSNKSFVVWNPPDFARDLLPRYFKHNNFSSFIRQLNTYGFRKVDPEKWEFANEDNFFRGQPHLLKNIHRRKPVHSHSAQNLHGLSSPLTESERQGYKEDIQKLKHENESLHLDLQRHQQDRQGLELQMQVFTERVQHVEHRQKTMLSALARMLDKPVTDLSRMPQLQVNDRKRRLPGNSCLYNETDLEDTRAISSRALTWENMNPSSLLTINAELLNQLDSSLTFWENVLQDVDQAWIQQNCSLELDESTSCADSPAISYTQLNVDVGPKASDIDMNSEPNANTNPEVAAPEDQAAVAGTTTNVPTGVNDIFWEQFLTENPGSVDASEVQSERKDIGNKKNESKPVDSGKFWWNMKSVNSLAEQLGHLTPAEKT

SEQ ID NO: 402 - protein, 308 aa, Zea mays
  misc_feature: Public GI ID no.886742
  misc_feature: Bit score of 62.0 for HMM based on sequences of FIGURE 11.
  misc_feature (8)..(101): Pfam Name: HSF_DNA-bind Pfam Description: HSF-type DNA-binding
  misc_feature: Functional Homolog Of Ceres LOCUS ID no. At2g26150 at SEQ ID NO. 364
MEGASSLPPFLSKTYEMVDDPATDAVVAWTPLGTSFVVANQAEFWRDLLPKYFKHNNFSSFVRQLNTYGFKKIDPEQWEFANDDFIRGQQHRLKNIHRRKPIFSHSSHTQGSGPLPDTERRDYEEEIERLKCDNAALTSELEKNAQKKLVTEKRMQDLEDKLIFLEDRQKNLMAYVRDIVQAPGSFSSFVQQPDHHGKKRRLPVPISLYQDSNAKGNQVVHGSFITNPPACRESFDKTESSLNSLENFLREASEAFNISYDDGLPGLHLLSLSQSSIRPEKVIPMCHHLSQECIHLRLVREIRSLPAI

SEQ ID NO: 403 - DNA, 1511 bp, Panicum virgatum
  misc_feature: Ceres CLONE ID no.1814498
  misc_feature: Encodes the peptide sequence at SEQ ID NO 404
agcgagagcccccggccaccaaccaaccaaaccccaagcaagcagccgcgagcccaaatccgccggatcacaccgggcatgcgccgagcccccgccgccgccgccgcagcagcagcagcctgagtaggaggacgaggggggaggctggtctcgggtggggatggaggcgggcggcgggggcgcgtcctcgttgccgccgttcctgagcaagacgtacgagatggtggacgacccggccacggacgccgtggtggcgtggacgccgccggggaccagtttcgtcgtcgccaaccaggccgagttctgcagggatctgctccccaagtacttcaagcacaacaacttctccagcttcgtgcggcagctcaacacctacggcttcagaaaaattgatcctgagcaatgggagtttgcaaatgaggatttcattaggggacaacggcaccgactgaaaaatatacataggcgcaaacccatattcagtcactcatcacacaatcaggtttctgcaccgttagcagatcatgaaaggcgggaatatgaagaggaaatcgagaagctcaagtgcgagaatgcagatctcatctcagagcttgaaaagaatgcggaaaagaaacttgatatggagagacgaatgcaggagctggataataagttgatatctttggaggatcggcaaaagaatctgatagcttatgtcagagatattgtacgggcaccaggatttcgctctagctttgtgcagcaaactgatcatcacggaaagaaaaggagactactaatacctgcttctctccaccaagatgcaaataccgaggggaatcagattgtgcatgggggcttaacgaacccaccagtttacagagaatcatttgacaaaatggagtcttccttgaactcattggagaatttctttcgagaagcaagtgaagcatttgatatttcatatgatgatggtgtcccgggaccttcatctgccattgttatcacagagctccattcatctggagaaagtgatcctgttgtaccatcacctccatcaaggatgcatacctcttcagctggtgcaggagattcactctcaaggatgcatacctcttcagctggtgcaggagattcgctctcttctcatgacgtatcagggtcaactagctgcgcagaaagtcctcccctccctcaaatgcagtcctgtacagattcacgagctaaggtgtctgagatcgatgttaatcttgagcctgctattacagaaactggtccatcaagggatcaacctgccgaggaccatccaagtttagcacctgcaaatgatggcttttgggagcaatttcttactgagcagcctggttccaatgcacatcagggggtccaatcagaaaggcgagatggagacagtaaagatgatcggacgagaacaggagatcaggaaaacttatggggggggaaagaagaatgtggaacagatgacagaaaagctgggggcatcycaccycggcggagaaaaccaaacg

SEQ ID NO: 404 - protein, 450 aa, Panicum virgatum
  misc_feature: Ceres CLONE ID no.1814498
  misc_feature: Bit score of 59.2 for HMM based on sequences of FIGURE 11.
  misc_feature (12)..(105): Pfam Name: HSF_DNA-bind Pfam Description: HSF-type DNA-binding
  misc_feature: Functional Homolog Of Ceres LOCUS ID no. At2g26150 at SEQ ID NO. 364
  misc_feature (443)..(443): Xaa is any aa, unknown, or other
  misc_feature (444)..(444): Xaa is any aa, unknown, or other
MEAGGGGASSLPPFLSKTYEMVDDPATDAVVAWTPPGTSFVVANQAEFCRDLLPKYFKHNNFSSFVRQLNTYGFRKIDPEQWEFANEDFIRGQRHRLKNIHRRKPIFSHSSHNQVSAPLADHERREYEEEIEKLKCENADLISELEKNAEKKLDMERRMQELDNKLISLEDRQKNLIAYVRDIVRAPGFRSSFVQQTDHHGKKRRLLIPASLHQDANTEGNQIVHGGLTNPPVYRESFDKMESSLNSLENFFREASEAFDISYDDGVPGPSSAIVITELHSSGESDPVVPSPPSRMHTSSAGAGDSLSRMHTSSAGAGDSLSSHDVSGSTSCAESPPLPQMQSCTDSRAKVSEIDVNLEPAITETGPSRDQPAEDHPSLAPANDGFWEQFLTEQPGSNAHQGVQSERRDGDSKDDRTRTGDQENLWGGKEECGTDDRKAGGIXXRRRKPN

SEQ ID NO: 405 - protein, 402 aa, Medicago sativa
  misc_feature: Public GI ID no.7158882
  misc_feature: Bit score of 70.2 for HMM based on sequences of FIGURE 11.
  misc_feature (11)..(120): Pfam Name: HSF_DNA-bind Pfam Description: HSF-type DNA-binding
  misc_feature: Functional Homolog Of Ceres LOCUS ID no. At2g26150 at SEQ ID NO. 364
MDEAGSSSSLPPFLAKTYEMVDDRSSDPIVSWSASNKSFVVWNPPEFARVLLSEILKHNNFSSFIRQLNTYGFRKVDPEQWEFANDDFIRGQPHLMKNIHRRKPVHSHSLHNLQAQASLTESERQSMIDEIEKLKQDREQLLVETKRYQHDWERHEIQMHCSKDQLEKLEHKQQKMLSSVSEALQKPMIAVNLLPLAEAMERKRRLPARSVCFNNEASVEDAMETSVALPRENSEDNFYFDVKHREIGSTSRHPWHFGKTLAHEVGDNFVHTHSNMDLDESTCCADRLSISCQQLDGEVRPKSPEIDMNVEPAAAALEAVAVKEQPARITTAATGVNDVFWEQFLTEDPGASEAQEVQSERKDNSSRKNEGKPSDHGRFWWNMRKSNNHPEQMGHVSQVEKI

SEQ ID NO: 406 - DNA, 1191 bp, Populus balsamifera subsp. trichocarpa
  misc_feature: Ceres ANNOT ID no.1455221
  misc_feature: Encodes the peptide sequence at SEQ ID NO 407
atggagggagttgtagtgaaagaagaggagacagtgacatgtactggaggtggagcttcttcatcttcatcatcctctagtttctctccgcatccaatggaggggttaaatgaagtgggcccacctccgttcttgacgaagacatatgaaatggtggaagacccttcaacggatacagtggtttcgtggagtggaggtcgcaatagcttcatagtttgggactctcataagttctctactactttgcttccgaaacacttcaaacacagtaacttctccagcttcattcgacagctcaacacttatggtttcaggaaggttgatcctgaccggtgggaatttgccaatgaagggtttttgggagggcagaagcatctattgaagaccatcaaacggaaaagacatctctcacagaccacacaacaacaaggtggaggagcttgcattgagttaggacaatttgaatttgaaggagagcttgaaaggttaaaaagagaccgaaacgtgttaatggcagagattgtaaggcttaggcagcaacaacagcagtcgagggaacacattgctgcgatggaggataggttacgaagcacagagagaaaacagcagcgggtgatgacattccttgctaaagctctcaacaacccatcctttatcgagcaatttgcacaaagggctgcacagaggagagaaataagaggtgttgaaattgggcgtaagaggagactcactgcaagcccaagtgttgaaaatttgcaagaagttgcatctgtggcattaggtagcagccaatttgttgattacatgaatcaggatttaccaactattgagaacgagatggagacgcttttctctgctgtcttggacaatgaatcaagcagtgatatcaaggacccaatagcaagttctatggacacagcaagtggtggtagcactttggatgctgttaatgagacaatttgggaggagttacttactgatgatttagtttccggggaacctaatgaagttgttgtgagtgatgaaccagaagttgatgtggaagttgaggatttggttgcgaaacctgtggactggagtgatgattttcaggaccttgtggatcaaatgggttatctcaggagggagtggtggaagttccaacacggccaacagatgttactctgctcttctgtttccttcttgaattag

SEQ ID NO: 407 - protein, 396 aa, Populus balsamifera subsp. trichocarpa
  misc_feature: Ceres ANNOT ID no.1455221
  misc_feature: Bit score of 1032.2 for HMM based on sequences of FIGURE 11.
  misc_feature (42)..(209): Pfam Name: HSF_DNA-bind Pfam Description: HSF-type DNA-binding
  misc_feature: Functional Homolog Of Ceres LOCUS ID no. At2g26150 at SEQ ID NO. 364
MEGVVVKEEETVTCTGGGASSSSSSSSFSPHPMEGLNEVGPPPFLTKTYEMVEDPSTDTVVSWSGGRNSFIVWDSHKFSTTLLPKHFKHSNFSSFIRQLNTYGFRKVDPDRWEFANEGFLGGQKHLLKTIKRKRHLSQTTQQQGGGACIELGQFEFEGELERLKRDRNVLMAEIVRLRQQQQQSREHIAAMEDRLRSTERKQQRVMTFLAKALNNPSFIEQFAQRAAQRREIRGVEIGRKRRLTASPSVENLQEVASVALGSSQFVDYMNQDLPTIENEMETLFSAVLDNESSSDIKDPIASSMDTASGGSTLDAVNETIWEELLTDDLVSGEPNEVVVSDEPEVDVEVEDLVAKPVDWSDDFQDLVDQMGYLRREWWKFQHGQQMLLCSSVSFLN

SEQ ID NO: 408 - protein, 351 aa, Lycopersicon peruvianum
  misc_feature: Public GI ID no.729774
  misc_feature: Bit score of 883.6 for HMM based on sequences of FIGURE 11.
  misc_feature (30)..(197): Pfam Name: HSF_DNA-bind Pfam Description: HSF-type DNA-binding
  misc_feature: Functional Homolog Of Ceres LOCUS ID no. At2g26150 at SEQ ID NO. 364
MEDVMKVKVEEDGIPTAVLPMEGLHDVGPPPFLSKTYEMVEDSSTDQVISWSTTRNSFIVWDSHKFSTTLLPRFFKHSNFSSFIRQLNTYGFRKVDPDRWEFANEGFLGGQKHLLKTIKRRRNVGQSMNQQGSGACIEIGYYGMEEELERLKRDKNVLMTEIVKLRQQQQSTRNQIIAMGEKIETQERKQVQMMSFLAKIFSNPTFLQQYLDKQVHRKDKQRIEVGQKRRLTMTPSVTGSDQPMNYSSSLQESEAELASIEMLFSAAMDNESSSNVRPDSVVTANGTDMEPVADDIWEELLSEDLISGDRAAEEVVVVEQPEFDVEVEDLVVKTPEWGEELQDLVDQLGFL

SEQ ID NO: 409 - DNA, 2073 bp, Zea mays
  misc_feature: Ceres CLONE ID no.1414288
  misc_feature: Encodes the peptide sequence at SEQ ID NO 410
gaacgtgctcttctcgcccgcccggtcttgtctctcctctccagaaccttccaacggcagagtgctcgccgcgtggtctagaaccttccacaagcctcgcgacgtgtctcgacgcgccggtacggcggtgggggtatttaggggtccggccaccggccaccgcccgcccttcccccgatttcaccgaccattttccccattttacagcggcgaatatctctcatctcccccgtcctctttgctgcaacacctcctacccacccgacagaaatatcctaagcgccgacccgaatacccgattcgctcctcgtccggtcgattcctgctcctaatcgctcgaatcgagtccttgccccgtgttccgtgccacaatctgggcgcttggctcccgcgagccggggttcttgggcctgggcggaggccatggacaagccggtggcgccgggcattatcaaggaggagctcctggagcagcagccgccgacgcaggacggtgtgggtggcggcggggatgcgccgcgcccgatggaggggctgcacgaggtgggtcccccgcctttcctcaccaagacgttcgaccttgtggaggacccggccaccgacgccgtcctctcctggagccgcgccggcaacagcttcatcgtctgggacccgcacgtcttcgcctacgggctgctcccgcgcctcttcaagcacagtaacttctccagcttcgtgcgccagctcaacacctatggcttcagaaaggttgatcctgacaggtgggagtttgcaaatgaaggtttcctcagaggtcaaaggcacctgctgaagatgataaagagaaggaagccaccatcagctgtggcaccattgcgacagcaacgtgcccctgcttcttgcctggaggttggtgagtttggatttgaggaggagattgataggctgaagcgtgacaagaacattttaatcacagaagtagtaaaactaaggcaggagcagcaaagtactaaagatcatgtgagagccatggaggaaaggctacgagtggctgaacagaagcaggtacagatgatggggttcttggcaagagcaatgcggaacccagagttcttccagcagttggcccagcagcaagacaagaggaaggagctcgaggataccatctcaaagaaaagaaggcggcccattgacaacacaccattctacagtgatggggaaagcgaacagcttgattcacagttgaaaatgttcgagtcaggtgttctcaatgggctcaatgaacctgagctggagaatttagcagtgaacattcaggagcttgggaagggaagcatagatgatgggaacttgactcaagttagtgaccagtcagagctgaacgacgacttctgggcagagcttttggtcgaagattttggagacaaggcaggacagccagagttggagggaagaactgaagacgtgaatgaccttgctcaacaactggggtatctgagttcttctagcccaaaatagagccagttcctaatggttgcccccacaatcactggtgctttccctaccctactgttgcagaccatcctgatcaaaccgccaggaatgatgatggatctggcagacaagttgactggtggtggagaggtgttcatactgaaggcgtgctgtggagaggtcactgccttgacgttgaaggcttagcgctgtactctgctgtgggagttacgtgtggggtgttggctaaatgtctcttccggcgtcttctggcaaaatgatctcgtggacggtgactggcaaagatgcctaggggccaacgtatacgtacacagctgttatcagatcttgttcaaagtcattgcgcggttttgacggtgctatgtatcgatcagggttctggccttctggggttgggttgtagaattgactggctgatctagtgttctccatgtatgactggtgtaaccttaaaacaccctcagcttgttgttgaactgtgacaagcatctcgtttttttgttgtactccattttcatcatcattgtacatcaaattgctgaattatgaacagatccctaatgaaaaaaaaaaaaaaaa

SEQ ID NO: 410 - protein, 357 aa, Zea mays
  misc_feature: Ceres CLONE ID no.1414288
  misc_feature: Bit score of 894.8 for HMM based on sequences of FIGURE 11.
  misc_feature (44)..(214): Pfam Name: HSF_DNA-bind Pfam Description: HSF-type DNA-binding
  misc_feature: Functional Homolog Of Ceres LOCUS ID no. At2g26150 at SEQ ID NO. 364
MDKPVAPGIIKEELLEQQPPTQDGVGGGGDAPRPMEGLHEVGPPPFLTKTFDLVEDPATDAVLSWSRAGNSFIVWDPHVFAYGLLPRLFKHSNFSSFVRQLNTYGFRKVDPDRWEFANEGFLRGQRHLLKMIKRRKPPSAVAPLRQQRAPASCLEVGEFGFEEEIDRLKRDKNILITEVVKLRQEQQSTKDHVRAMEERLRVAEQKQVQMMGFLARAMRNPEFFQQLAQQQDKRKELEDTISKKRRRPIDNTPFYSDGESEQLDSQLKMFESGVLNGLNEPELENLAVNIQELGKGSIDDGNLTQVSDQSELNDDFWAELLVEDFGDKAGQPELEGRTEDVNDLAQQLGYLSSSSPK

SEQ ID NO: 411 - DNA, 1080 bp, Populus balsamifera subsp. trichocarpa
  misc_feature: Ceres ANNOT ID no.1452564
  misc_feature: Encodes the peptide sequence at SEQ ID NO 412
atgaatccatttttcactgtgaagcaagagtatgcaggatcaagttcatcgccaccgtccggcggtgatgagcccccaccagttatgctgccgccgcagccaagggaaggtttacatgatacaggaccaccaccattcctgactaagacttttgacatggtagatgacccaacgaccaatcacatagtttcttggaacagaggaggttctagctttgttgcctgggatcctcattcgttctccacaaatctccttcctagatacttcaaacataataatttttccagctttgtcaggcagctcaatacttatggttttagaaagattgatccagatagatgggagtttgccaatgaaggatttctgagcggtcaaaagcatctcttaaggaatataaagagaagaaaggcaccctctcagcctcttactcaacagcaagctccagatgcttgcgttgaagttggccgttttggattagatggagaaatcgatcgcttgagacgtgacaagcaggttttaatgatggaattagtgaaacttagacagcagcaacagaatgctagatcttatatacaagctatggaccaaaggctacaagcgatagagcaaaagcagcagcaaatgatgcaattcttagctagagcaatgcaaaatccagcctttttacagcagttagttcagcagaaggagaaaaggaaagagcttgaggaagcaatgactaaaaagagaaggcggcctattgatcaaggatctagtagaggtggtggtggtcgtcgtggtggtgaatcgagccatattggtggaagtgcaaaccccatcaaggcagagcctttagagtctggagaccttgaatttgaagtgtcagagctggaagcacttgcgttggaaatgcaagggtatggtagggcaaggagagagcaagaggatggagtagaagagctagagacaccagaaagtaaagatagagaacttgatgagggattttgggaagaactgttaaatgagagtgctggaggagatgaagatgatgtcaatacattagccgagcgcttgggttatctgggttcaagtcctaagtag

SEQ ID NO: 412 - protein, 331 aa, Populus balsamifera subsp. trichocarpa
  misc_feature: Ceres ANNOT ID no.1452564
  misc_feature: Bit score of 469.5 for HMM based on sequences of FIGURE 11.
  misc_feature (16)..(184): Pfam Name: HSF_DNA-bind Pfam Description: HSF-type DNA-binding
  misc_feature: Functional Homolog Of Ceres LOCUS ID no. At2g26150 at SEQ ID NO. 364
MLPPQPREGLHDTGPPPFLTKTFDMVDDPTTNHIVSWNRGGSSFVAWDPHSFSTNLLPRYFKHNNFSSFVRQLNTYGFRKIDPDRWEFANEGFLSGQKHLLRNIKRRKAPSQPLTQQQAPDACVEVGRFGLDGEIDRLRRDKQVLMMELVKLRQQQQNARSYIQAMDQRLQAIEQKQQQMMQFLARAMQNPAFLQQLVQQKEKRKELEEAMTKKRRRPIDQGSSRGGGGRRGGESSHIGGSANPIKAEPLESGDLEFEVSELEALALEMQGYGRARREQEDGVEELETPESKDRELDEGFWEELLNESAGGDEDDVNTLAERLGYLGSSPK

SEQ ID NO: 413 - protein, 358 aa, Oryza sativa subsp. japonica
  misc_feature: Public GI ID no.115482048
  misc_feature: Bit score of 899.4 for HMM based on sequences of FIGURE 11.
  misc_feature (41)..(210): Pfam Name: HSF_DNA-bind Pfam Description: HSF-type DNA-binding
  misc_feature: Functional Homolog Of Ceres LOCUS ID no. At2g26150 at SEQ ID NO. 364
MDPAAAGIVKEEMLESQQQQRQEDGGAAPRPMEGLHEVGPPPFLTKTYDLVEDPATDGVVSWSRAGNSFVVWDPHVFADLLLPRLFKHNNFSSFVRQLNTYGFRKVDPDRWEFANEGFLRGQRHLLKTIKRRKPPSNAPPSQQQSLTSCLEVGEFGFEEEIDRLKRDKNILITEVVKLRQEQQATKDHVKAMEDRLRAAEQKQVQMMGFLARAMRNPEFFQQLAQQKEKRKELEDAISKKRRRPIDNVPFYDPGETSQTEQLDSPYLFDSGVLNELSEPGIPELENLAVNIQDLGKGKVDEERQNQTNGQAELGDDFWAELLVEDFTGKEEQSELDGKIDGIDELAQQLGYLSSTSPK

SEQ ID NO: 414 - protein, 372 aa, Oryza sativa subsp. indica
  misc_feature: Public GI ID no.125557431
  misc_feature: Bit score of 522.9 for HMM based on sequences of FIGURE 11.
  misc_feature (51)..(219): Pfam Name: HSF_DNA-bind Pfam Description: HSF-type DNA-binding
  misc_feature: Functional Homolog Of Ceres LOCUS ID no. At2g26150 at SEQ ID NO. 364
MDDPMLNAVKEEESHGDGGGLEVVAGEDGAAAVAAGVAPRPMEGLHDAGPPPFLTKTYDMVDDAGTDAAVSWSATSNSFVVWDPHAFATVLLPRFFKHNNFSSFVRQLNTYGFRKVDPDRWEFANENFLRGQRHLLKNIKRRKPPSHTASNQQSLGPYLEVGHFGYDAEIDRLKRDKQLLMAEVVKLRQEQQNTKANLKAMEDRLQGTEQRQQQMMAFLARVMKNPEFLKQLMSQNEMRKELQDAISKKRRRRIDQGPEVDDVGTSSSIEQESPALFDPQESVEFLIDGIPSDLENSAMDAGGLVEPQDFDVGTSEQQQIGPQGELNDNFWEELLNEGLVGEENDNPVVEDDMNVLSEKMGYLNSNGPTAGE

SEQ ID NO: 415 - DNA, 1080 bp, Populus balsamifera subsp. trichocarpa
  misc_feature: Ceres ANNOT ID no.1442880
  misc_feature: Encodes the peptide sequence at SEQ ID NO 416
atgaatccatatctaacagtgaagcaagagtacgcaggatcaagtttattgcctctgtccggcggtgatgagccgccaacaatgatgctcccaccacagccgatggaaggtttacatgatacaggaccaccgccattcctgaccaagacttttgacatggtggatgacccaatgactaatcacatagtttcttggagcagaggagggtttagctttgttgtttgggatccttattctttctccgcaaatctccttcctagatacttcaagcataataatttctccagctttgtcaggcagctcaatacttatggctttagaaagattgatccagatagatgggagtttgccaatgaaggatttctgaggggtcaaaagcagcttctaaggaatataaagagaagaaaggcagcttctcagcctctttctcaacagcaagctccagatgcctgtgttgaagttagccgttttggattagatggagaaatcgatctcttgaaacgtgacaggcacgttttgatgatggaattagcgaagcttagacagcagcaacagaaagctagatcttatatacaagctatggagcaaaggctacaagggacagaacaaaagcagcagcagatgatgcaattcttagctcgagcaatgcaaaatcctgcctttctactgcagttagtccaacagaaagggaaaaggaaagaacttgaggaagcaatgactaaaaagagaagaattcctgttgatcaaagacctagtcgaagtggtggtggtgaatcaaaccgtattgatgaaagtgcaaaccccatcaaggcagaggctttagaatatggagactacggatttgaagtgtcagagctggaggcacttgcattggaaatgcaagggtatggcagggcaaggagagagcaagaggatggagtagaagagctagagccactagaaagcggagatagagaacttgacgagggattttgggaagaactgttaaatgagagtgctggaggaggtgaagatgaggatgtgaatacattagctgagcgcttgggttatttgcgttcaagtcctaagtacagaaattga

SEQ ID NO: 416 - protein, 331 aa, Populus balsamifera subsp. trichocarpa
  misc_feature: Ceres ANNOT ID no.1442880
  misc_feature: Bit score of 460.3 for HMM based on sequences of FIGURE 11.
  misc_feature (16)..(184): Pfam Name: HSF_DNA-bind Pfam Description: HSF-type DNA-binding
  misc_feature: Functional Homolog Of Ceres LOCUS ID no. At2g26150 at SEQ ID NO. 364
MLPPQPMEGLHDTGPPPFLTKTFDMVDDPMTNHIVSWSRGGFSFVVWDPYSFSANLLPRYFKHNNFSSFVRQLNTYGFRKIDPDRWEFANEGFLRGQKQLLRNIKRRKAASQPLSQQQAPDACVEVSRFGLDGEIDLLKRDRHVLMMELAKLRQQQQKARSYIQAMEQRLQGTEQKQQQMMQFLARAMQNPAFLLQLVQQKGKRKELEEAMTKKRRIPVDQRPSRSGGGESNRIDESANPIKAEALEYGDYGFEVSELEALALEMQGYGRARREQEDGVEELEPLESGDRELDEGFWEELLNESAGGGEDEDVNTLAERLGYLRSSPKYRN

SEQ ID NO: 417 - DNA, 1077 bp, Populus balsamifera subsp. trichocarpa
  misc_feature: Ceres ANNOT ID no.1463437
  misc_feature: Encodes the peptide sequence at SEQ ID NO 418
atgaatcgtcggggccgagcgatcaaggaggagtatgcaggtggtagttcaagcacatactcatcaggcatggcatctacagctattccacaaccaatggagggactccatgacccaggtcctcctccatttctcactaaaacttatgatataatagaagattcaagcacaaaccatattatctcttggagtagaggtaacaacagctttgttgtttgggatccccaagccttttccattagtctcctccctagatacttcaagcacaacaatttctcaagctttgttaggcagctaaacacatatgggtttagaaaggttgatccagatagatgggagtttgctaatgaaggatttctcagggggaaaaaacatcttctcaagactgttaggaggagaaaagctcctcaaactcagacttctcagcaagctctagaggcttgtgttgaagttggaacatttagactggatggggaagttgatcgattaagccgagacaaacaagtactaatggtggaactagtgaagcttagacagcaacaacagactactagagcttgccttcaacttatggaacaaagagttaaaaggaatgagaataaacagcaacatatgatgagtttcttggctagagcaatgcaaaatcccacctttgtgcagcaactagtccaacaaaaggacatgatgaaagagcttgaagaggagattagtaaaaagaaaaggcgaccgattgatcaagggcgtaataatgttgaggttggagaatttggccatggtgagggagtaggaacatttgttaaaattgaacctcgggagttcggtggtttttctgagtttgaagttccagaatttgtcaatctggctatgaacatgcaagaactaaatgaaaaccaactgatcaacttggatgaagaatgtattgaaaaaggagaagaatatgaaaataatggtaaagactttgatgaggctttctgggaagatttattgaatgaggatattggcgaacagggtgaagatgaggaagatgtaaacgtgttggttgagcagcttggttacttgggttatagtccaaagtag

SEQ ID NO: 418 - protein, 358 aa, Populus balsamifera subsp. trichocarpa
  misc_feature: Ceres ANNOT ID no.1463437
  misc_feature: Bit score of 482.7 for HMM based on sequences of FIGURE 11.
  misc_feature (42)..(209): Pfam Name: HSF_DNA-bind Pfam Description: HSF-type DNA-binding
  misc_feature: Functional Homolog Of Ceres LOCUS ID no. At2g26150 at SEQ ID NO. 364
MNRRGRAIKEEYAGGSSSTYSSGMASTAIPQPMEGLHDPGPPPFLTKTYDIIEDSSTNHIISWSRGNNSFVVWDPQAFSISLLPRYFKHNNFSSFVRQLNTYGFRKVDPDRWEFANEGFLRGKKHLLKTVRRRKAPQTQTSQQALEACVEVGTFRLDGEVDRLSRDKQVLMVELVKLRQQQQTTRACLQLMEQRVKRNENKQQHMMSFLARAMQNPTFVQQLVQQKDMMKELEEEISKKKRRPIDQGRNNVEVGEFGHGEGVGTFVKIEPREFGGFSEFEVPEFVNLAMNMQELNENQLINLDEECIEKGEEYENNGKDFDEAFWEDLLNEDIGEQGEDEEDVNVLVEQLGYLGYSPK

SEQ ID NO: 419 - protein, 510 aa, Glycine max; identical to SEQ ID NO: 321
  misc_feature: Public GI ID no.42415865
  misc_feature: Bit score of 872.7 for HMM based on sequences of FIGURE 11.
  misc_feature (29)..(204): Pfam Name: HSF_DNA-bind Pfam Description: HSF-type DNA-binding
  misc_feature: Functional Homolog Of Ceres LOCUS ID no. At2g26150 at SEQ ID NO. 364

SEQ ID NO: 420 - protein, 372 aa, Oryza sativa subsp. japonica
  misc_feature: Public GI ID no.33087081
  misc_feature: Bit score of 501.6 for HMM based on sequences of FIGURE 11.
  misc_feature (51)..(219): Pfam Name: HSF_DNA-bind Pfam Description: HSF-type DNA-binding
  misc_feature: Functional Homolog Of Ceres LOCUS ID no. At2g26150 at SEQ ID NO. 364
MDDPMLNAVKEEESHGDGGGLEVVAGEDGAAAVAAGLAPGPMEGLHDAGPPPFLTKTYDMVDDAGTDAAVSWSATSNSFVVWDPHAFATVLLPRFFKHNNFSSFVRQLNTYGFRKVDPDRWEFANENFLRGQRHLFKNIKRRKPPSHTASNQQSFGPYLEVGHFGYDAEIDRLKRDKQLLMAEVVKLRQEQQNTKANLKAMEDRLQGTEQRQKQMIAFLARVMKNPEFLKQLMSQNEMRKELQDAISKKRRRRIDQGPEVDDVGTSSSIEQESPALFDPQESVEFLIDGIPSDLENSAMDAGGLVEPQDFDVGASQQQQIGPQGELNDNFWEELLNEGLVGEENDNPVVEDDMNVLSEKMGYLNSNGPTAGE

SEQ ID NO: 421 - protein, 502 aa, Medicago sativa
  misc_feature: Public GI ID no.56117815
  misc_feature: Bit score of 1384.8 for HMM based on sequences of FIGURE 11.
  misc_feature (31)..(207): Pfam Name: HSF_DNA-bind Pfam Description: HSF-type DNA-binding
  misc_feature: Functional Homolog Of Ceres LOCUS ID no. At2g26150 at SEQ ID NO. 364
MDGASGGSGGGEGSTTQIPAPTPMLNANAPPPFLSKTYDMVDDPSTDAIVSWSATNNSFVVWDPPEFARDLLPKFFKHNNFSSFVRQLNTYGFRKVDPDRWEFANEGFLRGQKQLLKSISRRKPAHGHTQQQAQQPHGQSSSVGACVEVGKFGLEEEVERLKRDKNVLMQELVRLRQQQQTTDGQLQTMVQRLQGMEQRQQQMMSFLAKAVQSPGFFAQFVQQQNDSNRRITEVNKKRRLKQDGIAETTEQATPPDGQIVKYQPMMNETAKAMLRKIMKWDTPRVESFNKNPDNYLIGDGTSPSSAMDSSSSTSWNSGVTLQEVPPSSVQSTQIPMSTGTQGHIPSAEKPEILSVPQAAASANVMKDGTHAASTIPTSQADVIMPDIPSVPEIVPKSILDIPEDNYMAPETDDGFMDPSSLGSLPIDLDCLSPGADIDDLLSNSIWDDLLQTPIPEDFEANIDEISRGNEVQPTENGWDNNTQPLDQLTEQMGLLSSDAKRI

SEQ ID NO: 422 - protein, 561 aa, Medicago sativa
  misc_feature: Public GI ID no.115521217
  misc_feature: Bit score of 1314.0 for HMM based on sequences of FIGURE 11.
  misc_feature (31)..(207): Pfam Name: HSF_DNA-bind Pfam Description: HSF-type DNA-binding
  misc_feature: Functional Homolog Of Ceres LOCUS ID no. At2g26150 at SEQ ID NO. 364
MDGASGGSGGGEGSTTQIPAPTPMLNANAPPPFLSKTYDMVDDPSTDAIVSWSATNNSFVVWDPPEFARDLLPKFFKHNNFSSFVRQLNTYGFRKVDPDRWEFANEGFLRGQKQLLKSISRRKPAHGHTQQQAQQPHGQSSSVGACVEVGKFGLEEEVERLKRDKNVLMQELVRLRQQQQTTDGQLQTMVQRLQGMEQRQQQMMSFLAKAVQSPGFFAQFVQQQNDSNRRITEVNKKRRLKQDGIAETTEQATPPDGQIVKYQPMMNETAKAMLRKIMKWDTPRVESFNKNPDNYLIGDGTSPSSAMDSSSSTSWNSGVTLQEVPPSSVQSTQIPIMKWDTPRVESFNKNPDNYLIGDGTSPSSAMDSSSSTSWNSGVTLQEVPPSSVQSTQIPMSTGTQGHIPSAEKPEILSVPQAAASANVMKDGTHAASTIPTSQADVIMPDIPSVPEIVPKSILDIPEDNYMAPETDDGFMDPSSLGSLPIDLDCLSPGADIDDLLSNSIWDDLLQTPIPEDFEANIDEISRGNEVQPTENGWDNNTQPLDQLTEQMGLLSSDAKRI

SEQ ID NO: 423 - protein, 502 aa, Medicago sativa
  misc_feature: Public GI ID no.115521211
  misc_feature: Bit score of 1372.9 for HMM based on sequences of FIGURE 11.
  misc_feature (31)..(207): Pfam Name: HSF_DNA-bind Pfam Description: HSF-type DNA-binding
  misc_feature: Functional Homolog Of Ceres LOCUS ID no. At2g26150 at SEQ ID NO. 364
MDGASGGSGGGEGSTTQIPAPTPMQNANAPPPFLSKTYDMVDDPSTDAIVSWSATNNSFVVWDPPEFARDLLPKFFKHNNFSSFVRQLNTYGFRKVDPDRWEFANEGFLRGQKQLLKSISRRKPAHGHTQQQAQQPHGQSSSVGACVEVGKFGLEEEVERLKRDKNVLMQELVRLRQQQQTTDGQLQTMVQRLQGMEQRQQQMMSFLAKAVQSPGFFAQFVQQQNDSNRRITEVNKKRRLKQDGIAETTEQATPPDGQIVKYQPMMNETAKAMLRKIMKWDTPRVESFNKNPDNYLIGDGTSPSSAMDSSSSTSWNSGVTLQEVPPSSVQSTQIPVSTGTQGHIPSAEKPEILSVPQAAASANVMKDGTHAASTIPTSQADVIMPDIPSVPEIVPKSILDIPEDNYMAPETDDGFMDPSSLGSLPIDLDCLSPGADIDDLLSNSIWDDLLQTPIPEDFEANIDEISRGNEVQPTENGWDNNTQPLDQLTEQMGLLSSDAKRI

SEQ ID NO: 424 - protein, 502 aa, Medicago sativa
  misc_feature: Public GI ID no.115521215
  misc_feature: Bit score of 1369.9 for HMM based on sequences of FIGURE 11.
  misc_feature (31)..(207): Pfam Name: HSF_DNA-bind Pfam Description: HSF-type DNA-binding
  misc_feature: Functional Homolog Of Ceres LOCUS ID no. At2g26150 at SEQ ID NO. 364
MDGASGASGGGEGSTTQIPAPTPMQNANAPPPFLSKTYDMVDDPSTDAIVSWSATNNSFVVWDPPEFARDLLPKFFKHNNFSSFVRQLNTYGFRKVDPDRWEFANEGFLRGQKQLLKSISRRKPAHGHTQQQAQQPHGQSSSVGACVEVGKFGLEEEVERLKRDKNVLMQELVRLRQQQQTTDGQLQTMVQRLQGMEQRQQQMMSFLAKAVQSPGFFAQFVQQQNDSNRRITEVNKKRRLKQDGIAETTEQATPPDGQIVKYQPMMNETAKAMLRKIMKWDTPRVESFNKNPDNYLIGDGTSPSSAMDSSSSTSWNSGVTLQEVPPSSVQSTQIPVSTGTQGHIPSAEKPEILSVPQAAASANVMKDGTHAASTIPTSQADVIMPDIPSVPEIVPKSILDIPEDNYMAPETDDGFMDPSSLGSLPIDLDCLSPGADIDDLLSNSIWDDLLQTPIPEDFEANIDEISRGNEVQPTENGWDNNTQPLDQLTEQMGLLSSDAKRI

SEQ ID NO: 425 - DNA, 1533 bp, Populus balsamifera subsp. trichocarpa
  misc_feature: Ceres ANNOT ID no.1454376
  misc_feature: Encodes the peptide sequence at SEQ ID NO 426
atggtggttccagacggtggcgattttttcggctacgctcttgccggtgtttcttctgcatcattttctgcaacagctatgttaccaaaactcattttggatgatgatcattcattgacaaatgcaataaaatcggagaaagatcataaagtgggtcaagagagtaatatgtcccctttacacgacaccgcttgttgcggtggaggcggcgggacttcatctccatcatcatcatcatcaatgaatacaagagaaatgcagaaagcagcagcagtactggaggtagaggaggagaaaagaatcaaagcaacagcagtcacggtcaaagaagaagatgatgatggtgtagatagtctcaatgagttgaagggaggaggcggtggcggtaataataaaaataacaatgggatatcgtcgtcttcgtgttcctctgtggatttacctaaacccatggagggtttacatgaggcaggtccacctccgtttctgaagaagacatttgagatggtgggggatccggaaacggatgaaacagtgtcgtggggcaagaatcgcgatagttttgttgtttgggactctcatgaattctctaaaaatctgcttccaaagtatttcaagcacagtaatttctccagcttcattcgccagctaaatacctacggctttagaaagattgatccggatagatgggagtttgcaaatgaagggtttcacggtgccaagaagcatttgctaaagaccatcaagagaagaagcaggtataacaaacagcagagcggagcagttactggcgtcaatgattcaacaaaacctcgtttggaagctgaacttgaaaatctgaaggatgatcaggatgttttaaggttggaaatcttgaaaattagacagaagcagcaggagtcgcaaactcaactgagtgctgttgaagaacgcattcaagctgcagagtgcaagcaattgcagatgtttattttctttaccaaagctgccagaaatcctggatttattcaacaactaatccagaagagaaagcaaaaagggaaggtagatgggattgaattttgcaagaaaagacgactgcttcaaacccatctccctgaaagctttcctgctgccgtggataccaaccaaagcgtccattttaaaaaccatgctcaggaacaactggccacaatgcagaccgaaattactgagattttaactgaggatgtggagacctgccaaatgttgaaagtatttccagctccaatgagtgatgggttttgctgtccgatacttcaagatcataatgcaaatataatgtgcgaaaaaagtactcaagatatgtcctctgcttataatctaatgtcagagaagctactggatgatggttcggtgattgaggatttggttgatgaggaggtagatgtcaatgactcaaaactctaccttgaattagaggatttgattgggatgccacgaatgtggggtggatttgcaaccgagttagtagggcatacagctggttgtgttggatcaattcccagattgtaa

SEQ ID NO: 426 - protein, 454 aa, Populus balsamifera subsp. trichocarpa
  misc_feature: Ceres ANNOT ID no.1454376
  misc_feature: Bit score of 312.4 for HMM based on sequences of FIGURE 11.
  misc_feature (104)..(270): Pfam Name: HSF_DNA-bind Pfam Description: HSF-type DNA-binding
  misc_feature: Functional Homolog Of Ceres LOCUS ID no. At2g26150 at SEQ ID NO. 364
MSPLHDTACCGGGGGTSSPSSSSSMNTREMQKAAAVLEVEEEKRIKATAVTVKEEDDDGVDSLNELKGGGGGGNNKNNNGISSSSCSSVDLPKPMEGLHEAGPPPFLKKTFEMVGDPETDETVSWGKNRDSFVVWDSHEFSKNLLPKYFKHSNFSSFIRQLNTYGFRKIDPDRWEFANEGFHGAKKHLLKTIKRRSRYNKQQSGAVTGVNDSTKPRLEAELENLKDDQDVLRLEILKIRQKQQESQTQLSAVEERIQAAECKQLQMFIFFTKAARNPGFIQQLIQKRKQKGKVDGIEFCKKRRLLQTHLPESFPAAVDTNQSVHFKNHAQEQLATMQTEITEILTEDVETCQMLKVFPAPMSDGFCCPILQDHNANIMCEKSTQDMSSAYNLMSEKLLDDGSVIEDLVDEEVDVNDSKLYLELEDLIGMPRMWGGFATELVGHTAGCVGSIPRL

SEQ ID NO: 427 - DNA, 1720 bp, Triticum aestivum
  misc_feature: Ceres CLONE ID no.835571
  misc_feature: Encodes the peptide sequence at SEQ ID NO 428
gagctcgctcaagcgcctcaagtacgaagcctagagggatagtactgtactttcctctcccttcttctccgtctgcggtctgctgcttctgggcgtcaatggggagctctgccattttaggagaagcggagatcccctgaattggtcaatcagcattagtttgtttggtcgtttgatcatggatccctttcacggcattgtgaaagaggaggaattcgacttcgccggagctgcagcggatggctactcgccgtcttcctggggctcatccccgtcttcctggggctcttcccaatcttcctgggccggcggcggcgccttggcagagctgccgcggccgatggacggcctcggcgaggcgggccccacgcccttcctgaacaagacgtacgaggtggtggacgaccacagcacggacaccatcgtgtcgtggggcgtcgccgggaacagcttcgtggtgtgggacgcccacgccttctccatggtgctcctcccccgctacttcaagcactgcaacttctccagcttcgtccgccagctcaacacctatgggttcaggaaggttgatccggacaggtgggagttcgcggcggaggggttcctgcggggccagaaggagctgctgaagacgatcaggcgccggcggcctcagtcgtcgccgtctggcacgccggcgctgctgcagcagcagcagcagggccagcagggggcgtgcctggaggtggggcatttcgggcccgagggcgaggtgcagcggctgcagcgcgacaagggcaccctgatcgcggaggtggtgaagctgcggcaggagcagcaggcgacgcgagcgcagatgcaggagatggaggcgcgcctcgccgccacggagcagaagcagcagcagatgacggtgttcctggcgcgcgccatgaagagccccagcttcctccagatgctggtgcagcggcaggaccagagccggcggaaggagctcgcggaggcgctcctctccaagaagcgcggccgccccatcgagtacctcctcccccgcaacggcgagaccagcagcgccgcaagctacagcgccgcggcgcgaggctacggccctggtctcgccgacggcagtgacggcaggcgcgcggacggcgaggacacggagagcttctggaaggagctgctgagcctgggcctggaggagaggcatcgggaggctggcgggggcggcggggaggcgagcggcgccgaggtggacgacgacgtggacgatgaggtggacgagctggtgcagagcctctaccacctcagcccgaaccggccccacagccaccagtgaaggaagaacagaagacagaaggttctagagcgagaaatatctgctgccgcttggagaacaacgtagggccgcagcctgacaagtgacaaccccagcagtgagcgaaagaagataagaaggttctagaacaagaagtttccgctggagaacgtcgaacgtcgtggggtagaccgtaggcgtagtggtggtggtggtagcggtagtgctgcctccatgcccccatgggcgttgggggctggtctgctttgttcattttctattgctagttgtagtacctgacatgttgtcggggccccgcggcctgcatgcgcaagttgcccgaaacagaaaggggccagcgccttttgcctggcgtggtggaataatgctccgaggctttaccggattaagtactccaagttggacgtg

SEQ ID NO: 428 - protein, 377 aa, Triticum aestivum
  misc_feature: Ceres CLONE ID no.835571
  misc_feature: Bit score of 372.9 for HMM based on sequences of FIGURE 11.
  misc_feature (64)..(240): Pfam Name: HSF_DNA-bind Pfam Description: HSF-type DNA-binding
  misc_feature: Functional Homolog Of Ceres LOCUS ID no. At2g26150 at SEQ ID NO. 364
MDPFHGIVKEEEFDFAGAAADGYSPSSWGSSPSSWGSSQSSWAGGGALAELPRPMDGLGEAGPTPFLNKTYEVVDDHSTDTIVSWGVAGNSFVVWDAHAFSMVLLPRYFKHCNFSSFVRQLNTYGFRKVDPDRWEFAAEGFLRGQKELLKTIRRRRPQSSPSGTPALLQQQQQGQQGACLEVGHFGPEGEVQRLQRDKGTLIAEVVKLRQEQQATRAQMQEMEARLAATEQKQQQMTVFLARAMKSPSFLQMLVQRQDQSRRKELAEALLSKKRGRPIEYLLPRNGETSSAASYSAAARGYGPGLADGSDGRRADGEDTESFWKELLSLGLEERHREAGGGGGEASGAEVDDDVDDEVDELVQSLYHLSPNRPHSHQ

SEQ ID NO: 429 - DNA, 1524 bp, Populus balsamifera subsp. trichocarpa
  misc_feature: Ceres ANNOT ID no.1500046
  misc_feature: Encodes the peptide sequence at SEQ ID NO 430
atggatggaacaatcaactctgcaagcggtggcgactcctcgatcagcggcggtggggcacaagcggcgtcggtgccgatggcgtcacagtcgaatgcgccgccgccatttctaagtaagacttacgacatggtagacgatccggcgacagacgcggtggtgtcttggagttcgacgaataatagttttgtggtttggaatccgccggagttcgctcgcgatcttttgccgaagtatttcaagcataataatttctccagctttgttaggcaactgaacacttacggttttcgaaaggtggatccagaccgttgggaatttgccaatgaaggatttttgaggggtcagaagcacctgcttaggattatcagtcggcgaaaacctgcccacgggcatgctaatcaacagccacaacaaccgcatggacagaactcatcagttgccgcctgtgttgaggttgggaaatttgggctcgaggaagaggtggagaggcttaagagggacaagaatgtccttatgcaagaacttgttaggttgaggcagcagcaacagtccacagatagccagttgcaaaccatggtacagcgacttcaaggaatggagcagcgtcagcaacagatgatgtcattcctggccaaggcgatgaacagcccaggcttcttggctcagtttgtacagcagcaaaatgacaacaataggcgcataacggaagccaataaaaaacgaaggctcaagcaggaggatgttcctgagaatgagggttctggttctcatgatgggcagattgtgaagtatcagcctctgatgaatgaggcagcccaagcaatgcttaggcagattatgaaaatggatgcttcttctaagttggaatcttatgacaataatcttggtgcaaaagacagtggaagctcttcgagccacacatcaggagtgactcttcaagaggttctgccaacttcagggcaatccgctcatataccagcagcttttgggatttccaggcagggcccatcggctccaatatctgaaatacaatcttccctgcaaattgctagttctgaaaaggttacagcttctcagtttccggatataagtatgccggttggagcacagggggcaacctccatacctattcctcaggcagatgtgatcatgccccatgtttctcaaatgcttgaaatggtaccagaaaatgttgctgatatcccttgtgaagattacatggaaccagagacatgcaatgatggattcatagatctagcttcattaggaattaatggaatacccatagatattgataacatttcccctgatcctgatattgatgctttgcttgataattctagcttctgggatgaccttcttgtgcagagtccagagcatgaggatattgaatcaagttctgtagagggtaaagccaatggaaatgatgtgcagccaaatgcaaacgggtgggacaaagctcagcatgtggatcagctgacagaacaaatggagcttctgacatcagacaagaagctttaa

SEQ ID NO: 430 - protein, 507 aa, Populus balsamifera subsp. trichocarpa
  misc_feature: Ceres ANNOT ID no.1500046
  misc_feature: Bit score of 772.4 for HMM based on sequences of FIGURE 11.
  misc_feature (35)..(211): Pfam Name: HSF_DNA-bind Pfam Description: HSF-type DNA-binding
  misc_feature: Functional Homolog Of Ceres LOCUS ID no. At2g26150 at SEQ ID NO. 364
MDGTINSASGGDSSISGGGAQAASVPMASQSNAPPPFLSKTYDMVDDPATDAVVSWSSTNNSFVVWNPPEFARDLLPKYFKHNNFSSFVRQLNTYGFRKVDPDRWEFANEGFLRGQKHLLRIISRRKPAHGHANQQPQQPHGQNSSVAACVEVGKFGLEEEVERLKRDKNVLMQELVRLRQQQQSTDSQLQTMVQRLQGMEQRQQQMMSFLAKAMNSPGFLAQFVQQQNDNNRRITEANKKRRLKQEDVPENEGSGSHDGQIVKYQPLMNEAAQAMLRQIMKMDASSKLESYDNNLGAKDSGSSSSHTSGVTLQEVLPTSGQSAHIPAAFGISRQGPSAPISEIQSSLQIASSEKVTASQFPDISMPVGAQGATSIPIPQADVIMPHVSQMLEMVPENVADIPCEDYMEPETCNDGFIDLASLGINGIPIDIDNISPDPDIDALLDNSSFWDDLLVQSPEHEDIESSSVEGKANGNDVQPNANGWDKAQHVDQLTEQMELLTSDKKL

SEQ ID NO: 431 - protein, 480 aa, Arabidopsis thaliana
  misc_feature: Public GI ID no.110738569
  misc_feature: Bit score of 504.9 for HMM based on sequences of FIGURE 11.
  misc_feature (36)..(219): Pfam Name: HSF_DNA-bind Pfam Description: HSF-type DNA-binding
  misc_feature: Functional Homolog Of Ceres LOCUS ID no. At2g26150 at SEQ ID NO. 364
MDGVTGGGTNIGEAVTAPPPRNPHPATLLNANSLPPPFLSKTYDMVEDPATDAIVSWSPTNNSFIVWDPPEFSRDLLPKYFKHNNFSSFVRQLNTYGFRKVDPDRWEFANEGFLRGQKHLLKKISRRKSVQGHGSSSSNPQSQQLSQGQGSMAALSSCVEVGKFGLEEEVEQLKRDKNVLMQELVKLRQQQQTTDNKLQVLVKHLQVMEQRQQQIMSFLAKAVQNPTFLSQFIQKQTDSNMHVTEANKKRRLREDSTAATESNSHSHSLEASDGQIVKYQPLRNDSMMWNMMKTDDKYPFLDGFSSPNQVSGVTLQEVLPITSGQSQAYASVPSGQPLSYLPSTSTSLPDTIMPETSQIPQLTRESINDFPTENFMDTEKNVPEAFISPSPFLDGGSVPIQLEGIPEDPEIDELMSNFEFLEEYMPESPVFGDATTLENNNNNNNNNNNNNNNNNNNNTNGRHMDKLIEELGLLTSETEH

SEQ ID NO: 432 - protein, 379 aa, Oryza sativa subsp. indica
  misc_feature: Public GI ID no.125542510
  misc_feature: Bit score of 536.3 for HMM based on sequences of FIGURE 11.
  misc_feature (36)..(224): Pfam Name: HSF_DNA-bind Pfam Description: HSF-type DNA-binding
  misc_feature: Functional Homolog Of Ceres LOCUS ID no. At2g26150 at SEQ ID NO. 364
MEKMMPGMVKEEWPPSSPEEGEAPRPMEGLHEVGPPPFLTKTFDLVADPATDGVVSWGRAGSSFVVWDPHVFAAVLLPRFFKHNNFSSFVRQLNTYFLVRTNYLNKQSHFYSLRFQGFRKIDPDRWEFANDGFLRGQRHLLKMIKRRRPLSYLPGSQQALGTCLEVGQFGLDEEIDRLKRDKNILLAEVVKLRHKQQSTKANMRAMEERLQHAEQKQVQMMGFLARAMQNPDFFHQLIHQQDKMKGLEDTFSKKRTRSIDIVPFLNPGEVSQGDQLESTLLFDPRPFAELNDEPAKSELENLALNIQGLGKGKQDVNRTRNQPRNQASNETELTDDFWEELLNEGARDDAGIPGMERRRPRYVDALAQKLGYLSNSSQK

SEQ ID NO: 433 - protein, 481 aa, Arabidopsis thaliana; identical to SEQ ID NO: 336
  misc_feature: Public GI ID no.30686034
  misc_feature: Bit score of 506.8 for HMM based on sequences of FIGURE 11.
  misc_feature (26)..(200): Pfam Name: HSF_DNA-bind Pfam Description: HSF-type DNA-binding
  misc_feature: Functional Homolog Of Ceres LOCUS ID no. At2g26150 at SEQ ID NO. 364

SEQ ID NO: 434 - protein, 384 aa, Oryza sativa subsp. japonica
  misc_feature: Public GI ID no.125570883
  misc_feature: Bit score of 246.2 for HMM based on sequences of FIGURE 11.
  misc_feature (73)..(168): Pfam Name: HSF_DNA-bind Pfam Description: HSF-type DNA-binding
  misc_feature: Functional Homolog Of Ceres LOCUS ID no. At2g26150 at SEQ ID NO. 364
MASSSSSSSLCRLLIPRPTTRRFSGGGGEGGMAAAAPVKREVKPEAGEGWGGGDLGVVPPPPRPMEGLGEAGPAPFVAKTYEMVADAATDAVVSWGPGGSGASFVVWDPHALAAGVLPRFFKHANFSSFVRQLNTYGFRKVTPDRWEFANEAFLAGQKHLLKNIKRRRVSKPLVDSQLRNKASVVFGQPEAPGEVVSLKRDRAALRAEVIMLKQQYNACKSQLIAMEEMVRNIERRQQQTIGFFAKVLTNPAFVQQVLLNYVNKNGLRGAAKRQRLMENEEQHADSPLNKGMEAASVMEADVSPGSTGCGTVGKVETTPMCNFQNIENMCDDVWEELDALPETGMEQEEKAGIGSFDVEEFVGRPCGWVDDCPYLVEPMQFVEH

SEQ ID NO: 435 - protein, 485 aa, Arabidopsis thaliana; identical to SEQ ID NO: 311
  misc_feature: Public GI ID no.42562463
  misc_feature: Bit score of 552.4 for HMM based on sequences of FIGURE 11.
  misc_feature (36)..(214): Pfam Name: HSF_DNA-bind Pfam Description: HSF-type DNA-binding
  misc_feature: Functional Homolog Of Ceres LOCUS ID no. At2g26150 at SEQ ID NO. 364

SEQ ID NO: 436 - protein, 198 aa, Gossypium hirsutum
  misc_feature: Ceres CLONE ID no.100043265
  misc_feature: Bit score of 113.4 for HMM based on sequences of FIGURE 11.
  misc_feature (45)..(195): Pfam Name: HSF_DNA-bind Pfam Description: HSF-type DNA-binding
  misc_feature: Functional Homolog Of Ceres LOCUS ID no. At2g26150 at SEQ ID NO. 364
MNPYFPVKEEYPNSSYSQSDDDPPLMMMGPPPPQPMESLRDSGPPPFLTKTFDIVDDPSTNYIVSWSRGGSSFVVWDPHAFSTNLLPRYFKHNNFSSFVRQLNTYGFRKTDPDKWEFANEGFLRGHKHLLKNIRRRKTTSQPPPSQQPLGPCVEVGRFGVDGEVGRLKRDKQVLMMELVKLRQQQQSTRAYIEAMEER

SEQ ID NO: 437 - DNA, 1089 bp, Sorghum bicolor
  misc_feature: Ceres ANNOT ID no.6089790
  misc_feature: Encodes the peptide sequence at SEQ ID NO 438
atggacccttcggtggcgccgggcattgtcaaggaggagctcctggagcagcagcagccgctgcaggacggtgtgggtgacggcgggggtgcgccgcgcccgatggaggggctgcacgaggtgggtcccccgccgttcctcaccaagacgttcgacctggtggaggacccggccaccgacgccgtcgtctcctggagccgtgccggcaacagcttcgtcgtctgggacccgcacgtcttcgccgacacgatgctcccacgcctcttcaagcacagcaacttctccagcttcgtgcgccagctcaacacctatggcttcagaaaggttgatcctgacaggtgggagtttgcaaatgaaggttttctcaggggtcaaaggcacctgcttaagatgataaagagaaggaagccaccatcagctgtgccaccattgcgacagcagcaggcccctgcttcttgcctggaggttggtgagtttggatttgaggaagagattgataggctgaagcgtgacaagaacattttgatcacagaagtagtaaagctaaggcaggagcagcaaactactaaagatcatgtgagggccatggaggaaaggctacgagtggctgaacagaagcaggttcagatgatggggttcttggcaagagcaatgcggaatccagagtttttccagcagttggtccagcagcaagacaagagaaaggagctcgaggatgctatttcaaagaaaagaaggcggcccattgacaacactccgttctacagtactggggaaacaagtcagggcgagcagcttgattcacagtttatgttcgagtcagatgtgctcaatgggctcagtgaacctggaatgcctgagctggagaatttagcagtgaacattcaggagcttgggaagggaagcatagatggcgagaaggtggctcaagctagtgaccagtcagagctgaatgatgacttctgggcagagctgttggtcgaagatttcggagacaaggcaggacagtcagagttggagggaagaactgaagacgtggatgaccttgctcaacaactggggtatctgagtaattctagcccaaagtag

SEQ ID NO: 438 - protein, 362 aa, Sorghum bicolor
  misc_feature: Ceres ANNOT ID no.6089790
  misc_feature: Bit score of 863.8 for HMM based on sequences of FIGURE 11.
  misc_feature (44)..(214): Pfam Name: HSF_DNA-bind Pfam Description: HSF-type DNA-binding
  misc_feature: Functional Homolog Of Ceres LOCUS ID no. At2g26150 at SEQ ID NO. 364
MDPSVAPGIVKEELLEQQQPLQDGVGDGGGAPRPMEGLHEVGPPPFLTKTFDLVEDPATDAVVSWSRAGNSFVVWDPHVFADTMLPRLFKHSNFSSFVRQLNTYGFRKVDPDRWEFANEGFLRGQRHLLKMIKRRKPPSAVPPLRQQQAPASCLEVGEFGFEEEIDRLKRDKNILITEVVKLRQEQQTTKDHVRAMEERLRVAEQKQVQMMGFLARAMRNPEFFQQLVQQQDKRKELEDAISKKRRRPIDNTPFYSTGETSQGEQLDSQFMFESDVLNGLSEPGMPELENLAVNIQELGKGSIDGEKVAQASDQSELNDDFWAELLVEDFGDKAGQSELEGRTEDVDDLAQQLGYLSNSSPK

SEQ ID NO: 439 - DNA, 1185 bp, Sorghum bicolor
  misc_feature: Ceres ANNOT ID no.6043635
  misc_feature: Encodes the peptide sequence at SEQ ID NO 440
atgggctcctcctcgtgcccgctctcgggctcccccgggccaagcggctccaattccaagcccaggacgacggcgcgcgccagcggcgtcgggttcggaggcgtagcaatggcgcggagcgtggccgtggcggcagtgaagctggagccgaagccggagccgtgggcggcgggcgcagaggaggcgtcgtcagtggtgccgcggtcgatggaggggccgccgctccctgcgccgttcgtgtcgaagacgtacgagatggtggcggacgcggccacggacgccgtggtgtcgtgggcgcccggcggcgcggggaacagcttcgtggtgtgggacccgcgggcgctcgccgccggcatcctcccgcgcttcttcaagcacgccaacttcgcgtccttcatcaggcagctcaacatctacggattcaggaaggtgaatccggatcgttgggagtttgcaaacgaatccttcttagcaggccagaagcatttgctgaaaaatatcaagaggaggcgtgcttccaagcctcagatggaagcaaagccaagaaactgtgctggtgcttgtctcggttcgccgaaggatcccagcgaggtcgagagtttgaaacgagaccgcgcagcgctcagggccgaagtcatcacgctaaggcagcagtacaacatctgcaaatcccaactcgtcgccttggaggagaggatcctgaacaacgagaggaaccagcagagggccatcgccttcttcgcaaaggtgctcagcaacccaggtttcgtgcagcaggtcctgctcaactatgccaaggagaaagaactacgtggcgcttccaaaagacagcggctgatggaaaacgaagaacatcggcacggcgatttgccactgaggagtggcaccgaagctgcgtttgcgacagtggcggctggcgttggcgtctctgcggggagcagccatggtggcacagccgcgaaacaggagcctgggcctgagttgaatggtcaggagatggacagtatttggtatgatgtgtgggacgagctggacgcgataccaggcgctgaaatggaccggcgagaagcagacaagggcgtggctggcttcgacgtcgaggatttcagtggacggccttgcggttgggatgatgactgctcgtatctcgcggagccgatgcagtttgtggagcactatgactag

SEQ ID NO: 440 - protein, 394 aa, Sorghum bicolor
  misc_feature: Ceres ANNOT ID no.6043635
  misc_feature: Bit score of 194.4 for HMM based on sequences of FIGURE 11.
  misc_feature (76)..(246): Pfam Name: HSF_DNA-bind Pfam Description: HSF-type DNA-binding
  misc_feature: Functional Homolog Of Ceres LOCUS ID no. At2g26150 at SEQ ID NO. 364
MGSSSCPLSGSPGPSGSNSKPRTTARASGVGFGGVAMARSVAVAAVKLEPKPEPWAAGAEEASSVVPRSMEGPPLPAPFVSKTYEMVADAATDAVVSWAPGGAGNSFVVWDPRALAAGILPRFFKHANFASFIRQLNIYGFRKVNPDRWEFANESFLAGQKHLLKNIKRRRASKPQMEAKPRNCAGACLGSPKDPSEVESLKRDRAALRAEVITLRQQYNICKSQLVALEERILNNERNQQRAIAFFAKVLSNPGFVQQVLLNYAKEKELRGASKRQRLMENEEHRHGDLPLRSGTEAAFATVAAGVGVSAGSSHGGTAAKQEPGPELNGQEMDSIWYDVWDELDAIPGAEMDRREADKGVAGFDVEDFSGRPCGWDDDCSYLAEPMQFVEHYD

SEQ ID NO: 441 - DNA, 715 bp, Arabidopsis thaliana
  misc_feature: Ceres SEEDLINE ID no.ME00029
  misc_feature: Encodes the peptide sequence at SEQ ID NO. 442
atattcatcactttcgttgttaagacggaaaaaaaaaaaacagaggcagaaccaaaaaactttagggttcgatttcgctccttggtaatcaccatgtccggagaagaagaagagaacgccgccgaactcaagatcggagatgagtttttgaaggcaaagtgcttaatgaactgtgaagtctctttgattcttgagcacaagtttgaacagcttcagcaaatctcagaggatcctatgaatcaagtttctcaagtgtttgagaagtccttgcaatatgtgaagcgattcagccgctacaagaatccagatgctgtaagacaagttcgagaaatactaagcagacatcaactcactgagtttgagctatgtgttcttggcaatctctgtcccgaaactgttgaagaagcagtggcaatggttccttctcttaagacaaaaggaagagctcatgatgatgaagctattgagaagatgctcaatgatctctcacttgtcaagagattcgagtagtgcagaagattctcaagatctaagattctgaacatttagcaggatgctttacttgccttctagctgatctggagttaattcgccacgtctgaaattataaagctttaatgcctagaatttctggaatgataccttcatgttaaatgaatgtaatttacaacggatgatccaagcttttaatgaaatataccatctctttttcacc

SEQ ID NO: 442 - protein, 138 aa, Arabidopsis thaliana
  misc_feature: Ceres SEEDLINE ID no.ME00029
  misc_feature: Bit score of 371.5 for HMM based on sequences of FIGURE 1.
  misc_feature (19)..(135): Pfam Name: RNA_pol_Rpb4 Pfam Description: RNA polymerase Rpb4
MSGEEEENAAELKIGDEFLKAKCLMNCEVSLILEHKFEQLQQISEDPMNQVSQVFEKSLQYVKRFSRYKNPDAVRQVREILSRHQLTEFELCVLGNLCPETVEEAVAMVPSLKTKGRAHDDEAIEKMLNDLSLVKRFE

SEQ ID NO: 443 - protein, 138 aa, Brassica rapa subsp. pekinensis
  misc_feature: Public GI ID no.72384401
  misc_feature: Bit score of 371.9 for HMM based on sequences of FIGURE 1.
  misc_feature (19)..(135): Pfam Name: RNA_pol_Rpb4 Pfam Description: RNA polymerase Rpb4
  misc_feature: Functional Homolog Of Ceres SEEDLINE ID no. ME00029 at SEQ ID NO. 442
MSGEEEENAAELKIGDEFLKAKCLMNCEVSLILEHKYEQLQQVSEDPMNQVSQVFEKSLQYVKRFSRYKNPDAVRQVREILSRHQLTEFELCVLGNLCPETAEEAVAMVPSLKTKGRAHSDEAIEKMLNDLSLVKRFE

SEQ ID NO: 444 - DNA, 514 bp, Brassica napus
  misc_feature: Ceres CLONE ID no.1079382
  misc_feature: Encodes the peptide sequence at SEQ ID NO 445
agagttgcttgtttcgctgtcagaacgagagaaaaaaagcttagggttcgatctcggttcactcgccatgtccggagaagaagaagaagagaacgccgccgagctcaagatcggagacgagtttttgaaggcgaagtgtttaatgaactgtgaagtgtctttgatccttgagcacaagtatgaacagcttcagctggtctccgaggatcctatgaaccaagtctctcaagtgtttgagaagtcgttgcagtatgtgaagcgttttagccgctacaagaatccagatgctgtacgacaagttcgagaaatactgagtagacatcaactcactgagtttgagctctgtgttcttggcaatctctgtcctgaaactgctgaagaagcagtggcaatggttccttctctcaagacgaaaggaagagctcatagtgatgaagcaattgagaagatgctcaatgatctctcccttgtcaagagattcgagtagtagtgcaaaacattctcaagattgaag

SEQ ID NO: 445 - protein, 139 aa, Brassica napus
  misc_feature: Ceres CLONE ID no.1079382
  misc_feature: Bit score of 365.4 for HMM based on sequences of FIGURE 1.
  misc_feature (20)..(136): Pfam Name: RNA_pol_Rpb4 Pfam Description: RNA polymerase Rpb4
  misc_feature: Functional Homolog Of Ceres SEEDLINE ID no. ME00029 at SEQ ID NO. 442
MSGEEEEENAAELKIGDEFLKAKCLMNCEVSLILEHKYEQLQLVSEDPMNQVSQVFEKSLQYVKRFSRYKNPDAVRQVREILSRHQLTEFELCVLGNLCPETAEEAVAMVPSLKTKGRAHSDEAIEKMLNDLSLVKRFE

SEQ ID NO: 446 - DNA, 911 bp, Gossypium hirsutum
  misc_feature: Ceres CLONE ID no.1853461
  misc_feature: Encodes the peptide sequence at SEQ ID NO 447
aacctagaaactcaaaatcaaattttaggttttctccgacttcacgcatcgaaatcaagcagacgaaaaccatctttgtctaataatgtctggcgaagaggaagaaaacgctgctgagctcaaaattggagaagagtttttgaaggcgaagtgtttgatgaattgtgaagtggctttaattctcgagcataagtatgagcagcttcagcaaatgtctgacgatcccatgaatcaagtttcccaggtattcgagaagtcactgcagtatgtaaaacgctttagccgttataaaaatccagatgctgtgagacaagttcgagaaattctgagtagatatcagttagctgaattcgagctttgtgttcttggcaacctgtgtcctgaaactgtggaggaagcaatcgctatggtgccttccatcaagactaaagggcgggctcacgacgacgatgccatcgagagaatgctaaatgacctttcccttatcaagaaatttgaatagtggccgctaaattactggctgtctatgacactgaagacatgaatagaatgttgaatgccccgtctcatataaaatatacatttttatctattttacccatgtcagtttgggattgacctaaaaagttgtagtgtgtcgaatggtttacgttctgtaaatttctcattaaggtgttgcaaacccgcatgtctcaaaacggcttttgctgttcattctcgtgattttttgtaagtttatactcttatgattgatctaattttttttcttcaaatgtaataattgcatttaatactatattgttgtaatatgtatattaattagtgaggtgaaaatatgagttgaaacatcgaatcatgatcaattgatctaaaaaaaaaaaaaaaaaaaaaaaaaaaaaaaaaaaaaaaaa

SEQ ID NO: 447 - protein, 138 aa, Gossypium hirsutum
  misc_feature: Ceres CLONE ID no.1853461
  misc_feature: Bit score of 380.8 for HMM based on sequences of FIGURE 1.
  misc_feature (19)..(135): Pfam Name: RNA_pol_Rpb4 Pfam Description: RNA polymerase Rpb4
  misc_feature: Functional Homolog Of Ceres SEEDLINE ID no. ME00029 at SEQ ID NO. 442
MSGEEEENAAELKIGEEFLKAKCLMNCEVALILEHKYEQLQQMSDDPMNQVSQVFEKSLQYVKRFSRYKNPDAVRQVREILSRYQLAEFELCVLGNLCPETVEEAIAMVPSIKTKGRAHDDDAIERMLNDLSLIKKFE

SEQ ID NO: 448 - DNA, 757 bp, Gossypium hirsutum
  misc_feature: Ceres CLONE ID no.1915549
  misc_feature: Encodes the peptide sequence at SEQ ID NO 449
aattcgattcgaaaccctaaatctcaatcccatttcaaaccccagacatcataaatctcaaacttcaaaaccttcatttctaaattggttattgaaaaccaaaaaaaaaaacagtttccttctgccttgggactgaaagagagcatttctaacaatgtctggcgaagaggaagaaaacgcagctgagctcaaaattggagaagagtttttgaaggcgaagtgtttgatgaattgtgaagtggctctaattcttgagcacaagtatgagcagcttcagcaaatgtctgacgatcccatgaatcaagtttcccaggtattcgagaagtcactgcagtatgtaaaacgcttcagccgttataaaaatccagattctgttaggcaagttcgagaaattttgagtagatatcagttagctgaattcgagctttgtgttcttggcaacctgtgtcctgaaactgtggaggaagcaatcgctatggtgccttccatcaagactaaaggacgggctcacgacgacgatgccatcgagagaatgctaaatgacttgtcccttatcaagaaatttgaatagtggccgctaaattactggctgtctatgacactgaagacattaatagaatgttgaatgccctttctcttataaaatatacatttttatctattttacccatgtgacccaaaaatcttaagtgtgtcaaatggtttatgttcagtaaatttctcattaaggtgctgcgaaaaaaaaaaaaaaaaaaaa

SEQ ID NO: 449 - protein, 138 aa, Gossypium hirsutum
  misc_feature: Ceres CLONE ID no.1915549
  misc_feature: Bit score of 377.9 for HMM based on sequences of FIGURE 1.
  misc_feature (19)..(135): Pfam Name: RNA_pol_Rpb4 Pfam Description: RNA polymerase Rpb4
  misc_feature: Functional Homolog Of Ceres SEEDLINE ID no. ME00029 at SEQ ID NO. 442
MSGEEEENAAELKIGEEFLKAKCLMNCEVALILEHKYEQLQQMSDDPMNQVSQVFEKSLQYVKRFSRYKNPDSVRQVREILSRYQLAEFELCVLGNLCPETVEEAIAMVPSIKTKGRAHDDDAIERMLNDLSLIKKFE

SEQ ID NO: 450 - DNA, 669 bp, Glycine max
  misc_feature: Ceres CLONE ID no.1626485
  misc_feature: Encodes the peptide sequence at SEQ ID NO 451
acaacatctcgcaaaactattcaaaaccagacacacacacaaacaaacgctgaatctctcgtcgttctttttatttgcggtttcttcttcttctcacgttctacctaacattttctaaaacatgtctggggaagaggaagaaaacgccgcagagctcaaaattggagacgagtttttgaaggcaaagtgcttaatgaactgtgaagtttcattgattcttgagcacaagtatgagcagcttcaacagacatccgatgatcccatgaatcaagtttctcaggtatttgaaaagtcactgcagtatgtgaagcgtttcagccgctataaaaatcctgatgctgttagacaagttcgagaaattctcgcaagatatcaattggctgagtttgagttgtgtgtccttggaaacctttgcccggaaactgtggaggaagctattgccatggttccatctatcaagtcaagaggacgggctcaggatgatgaagccatcgagaaaatgttaaatgacctgtcattgattaagaaatttgaataaatacgcagagtgtgtgatatagtgttgttggtaccgtataacatatcacttgactgcaagcatacattcatgtggtttgtattacagaaaacccttggtaattatatttagtagtttattttgtgacagtt

SEQ ID NO: 451 - protein, 138 aa, Glycine max
  misc_feature: Ceres CLONE ID no.1626485
  misc_feature: Bit score of 376.5 for HMM based on sequences of FIGURE 1.
  misc_feature (19)..(135): Pfam Name: RNA_pol_Rpb4 Pfam Description: RNA polymerase Rpb4
  misc_feature: Functional Homolog Of Ceres SEEDLINE ID no. ME00029 at SEQ ID NO. 442
MSGEEEENAAELKIGDEFLKAKCLMNCEVSLILEHKYEQLQQTSDDPMNQVSQVFEKSLQYVKRFSRYKNPDAVRQVREILARYQLAEFELCVLGNLCPETVEEAIAMVPSIKSRGRAQDDEAIEKMLNDLSLIKKFE

SEQ ID NO: 452 - DNA, 697 bp, Glycine max
  misc_feature: Ceres CLONE ID no.529871
  misc_feature: Encodes the peptide sequence at SEQ ID NO 453
agatagataagcatacgcaacgcaagaatagagaactgcgtagcgacccatcagagaagatcgcgatcttctgaaacatgtctggggaagaggaagaaaacgccgcagagctcaaaattggagacgagtttttgaaggcaaagtgcttaatgaactgtgaagttgcattgattcttgagcacaagtatgagcagcttcaacagacatccgatgatcccatgaatcaagtttctcaggtatttgaaaagtcactgcagtatgtgaagcgcttcagccgctataaaaatcccgatgctgttagacaagttcgagaaattctcgccagatatgaattggctgagtttgagttgtgtgtccttggcaacctttgcccagaaactgtggaggaagctattgctatggttccatctatcaagtcaagaggacgggctcaggatgatgaagcaatcgagaaaatgttaaatgacctgtcgttgattaagaaatttgaataaatacgtcaaagtgtgtgatataactgacatatcacttaactgcaagcaaacattcttgtggtttgtattacaaaaacgcttggtaattatatttagttcattttgtgactgttatcgagtaggattttgacacatgcgaactggtgtatgaaagtgcttttgacctgttatgatgattatgcgaatgtgattattgtcttacc

SEQ ID NO: 453 - protein, 138 aa, Glycine max
  misc_feature: Ceres CLONE ID no.529871
  misc_feature: Bit score of 375.8 for HMM based on sequences of FIGURE 1.
  misc_feature (19)..(135): Pfam Name: RNA_pol_Rpb4 Pfam Description: RNA polymerase Rpb4
  misc_feature: Functional Homolog Of Ceres SEEDLINE ID no. ME00029 at SEQ ID NO. 442
MSGEEEENAAELKIGDEFLKAKCLMNCEVALILEHKYEQLQQTSDDPMNQVSQVFEKSLQYVKRFSRYKNPDAVRQVREILARYELAEFELCVLGNLCPETVEEAIAMVPSIKSRGRAQDDEAIEKMLNDLSLIKKFE

SEQ ID NO: 454 - DNA, 512 bp, Brassica napus
  misc_feature: Ceres CLONE ID no.1067079
  misc_feature: Encodes the peptide sequence at SEQ ID NO 455
actgagattgtttcttttggccttataattctctttcactcgttcgacgagaaaaatcaaaatcaagagaagaaaaaagataatctctaaagggttcgatttgcctcgcaatgtctggagaagaagaagagaacgccgccgagctcaagatcggagacgagtttttgaaggcgaagtgcttaatgaactgtgaagtgtctttgatccttgagcacaagtacgagcagctgcagcaagtctctgaggatcctatgaatcaagtttctcaagtgtttgagaagtccttgcagtatgtgaagcgatttagccgctacaagaatccagatgctgttcgacaagttcgagaaatcttgagtagacatcaactcactgagtttgagctttgcgttcttggcaatctatgtcccgaaactgctgaagaagctgtggctatggttccttctctcaagacaaaaggaagagctcacagtgatgaatgcaattgagaagatgctcaatgatctctcccttgt

SEQ ID NO: 455 - protein, 124 aa, Brassica napus
  misc_feature: Ceres CLONE ID no.1067079
  misc_feature: Bit score of 302.9 for HMM based on sequences of FIGURE 1.
  misc_feature (19)..(122): Pfam Name: RNA_pol_Rpb4 Pfam Description: RNA polymerase Rpb4
  misc_feature: Functional Homolog Of Ceres SEEDLINE ID no. ME00029 at SEQ ID NO. 442
MSGEEEENAAELKIGDEFLKAKCLMNCEVSLILEHKYEQLQQVSEDPMNQVSQVFEKSLQYVKRFSRYKNPDAVRQVREILSRHQLTEFELCVLGNLCPETAEEAVAMVPSLKTKGRAHSDECN

SEQ ID NO: 456 - DNA, 476 bp, Brassica napus
  misc_feature: Ceres CLONE ID no.1079572
  misc_feature: Encodes the peptide sequence at SEQ ID NO 457
agatagtttctttggccttatacaataattctctttcactcgttcgacgagaaaaatcaaaatcaagagaagaaaaaagataatctaaaagggttcgatttgccacgcaatgtctggagaagaagaagagaacgccgccgagctcaagatcggcgacgagtttttgaaggcgaagtgcttaatgaactgtgaagtgtcgttgatcctcgagcacaagtacgaacagcttcagcacgtctccgaggatcctatgaatcaagtttctcaagtgtttgagaagtcgttgcagtatgtgaagcgatttagccgctacaagaatccagatgctgttcgacaagttcgagaaatcctgagtagacatcagctcactgagtttgagctttgtgttcttggcaatctctgtcctgaaactgctgaagaagcagtggctatggttccctccctcaagacaaaaggaagagctcatagtgatgaag

SEQ ID NO: 457 - protein, 122 aa, Brassica napus
  misc_feature: Ceres CLONE ID no.1079572
  misc_feature: Bit score of 303.3 for HMM based on sequences of FIGURE 1.
  misc_feature (19)..(122): Pfam Name: RNA_pol_Rpb4 Pfam Description: RNA polymerase Rpb4
  misc_feature: Functional Homolog Of Ceres SEEDLINE ID no. ME00029 at SEQ ID NO. 442
MSGEEEENAAELKIGDEFLKAKCLMNCEVSLILEHKYEQLQHVSEDPMNQVSQVFEKSLQYVKRFSRYKNPDAVRQVREILSRHQLTEFELCVLGNLCPETAEEAVAMVPSLKTKGRAHSDE

SEQ ID NO: 458 - DNA, 740 bp, Musa acuminata
  misc_feature: Ceres CLONE ID no.1713920
  misc_feature: Encodes the peptide sequence at SEQ ID NO 459
gcgcgcagagaagtcgatccactccgtcgacgcccacctttcgttccctcgtctccgcctcctgaatctttcaagtttctttgccgggcgaacatgtctggggaggaggaagagaacgccgccgaactaaagatcggcgaagaatttttgaaggcaaagtgtttgatgaactgtgaagttgcacgtattctggaccataaatatgaccagcttcagcagacgtcagatgatcctacaaaccagatatcccaggtgtttgaaaagtcaatgcagtatgtgaagcgctttagccgctacaagaaccctgatgcagtgagacaagtccgagaagtgttaagcagatataagttggctgaatttgagctttgtgtgctcggaaatctctgtcctgaaactgttgaagaagctatcgcaattgtcccatctatcaagagcaaagggcggatgcttgaagatgatgcgatcgagaaaatgctgcatgatctctcactgattaagaaatttgaatagtttcattcatgcagtgaacggtttgaacactttcggggtgcagcttatttaggttgatgttagtgacttatcctatgggtaataattagaacttaaaaccttttgagacttgtgtaggatctgttggacagaatctatcaatccagttatctcctaataccatgtaagagttggataattgaatctgatgttcataagcaaataaccaaatcagatgattattaggtgac

SEQ ID NO: 459 - protein, 138 aa, Musa acuminata
  misc_feature: Ceres CLONE ID no.1713920
  misc_feature: Bit score of 371.2 for HMM based on sequences of FIGURE 1.
  misc_feature (19)..(135): Pfam Name: RNA_pol_Rpb4 Pfam Description: RNA polymerase Rpb4
  misc_feature: Functional Homolog Of Ceres SEEDLINE ID no. ME00029 at SEQ ID NO. 442
MSGEEEENAAELKIGEEFLKAKCLMNCEVARILDHKYDQLQQTSDDPTNQISQVFEKSMQYVKRFSRYKNPDAVRQVREVLSRYKLAEFELCVLGNLCPETVEEAIAIVPSIKSKGRMLEDDAIEKMLHDLSLIKKFE

SEQ ID NO: 460 - DNA, 495 bp, Populus balsamifera subsp. trichocarpa
  misc_feature: Ceres ANNOT ID no.1456550
  misc_feature: Encodes the peptide sequence at SEQ ID NO 461
atggaagcatggcttatttttgtcttgattgcaatgaaatatagattcacttttcaaccccaaatcgatcatcccaaactcagtcacacagtctctctaaaggaaaaacctgaaaagaatagtctaagtatgtctggagaagaggaagagaatgcggccgagctcaaaatcggagatgattttttgaaggccaagtgcttaatgaattgtgaggttgctttaattcttgagcataagtatgagcagcttcaacagatgtctgatgatcctatgaatcaagtatcccaagtatttgagaaatcactgcagtatgtgaagcgctttagccgctacaaaaatcccgatgctctttgtgttcttggcaacctttgtcctgaaacagtggaggaagctattgccatggtaccttctatcaagaccaaaggccgagctcatgatgatgaagcaatcgaaaaaatgctgaatgacctgtccttgatcaagaaatttgaatag

SEQ ID NO: 461 - protein, 121 aa, Populus balsamifera subsp. trichocarpa
  misc_feature: Ceres ANNOT ID no.1456550
  misc_feature: Bit score of 301.6 for HMM based on sequences of FIGURE 1.
  misc_feature (19)..(118): Pfam Name: RNA_pol_Rpb4 Pfam Description: RNA polymerase Rpb4
  misc_feature: Functional Homolog Of Ceres SEEDLINE ID no. ME00029 at SEQ ID NO. 442
MSGEEEENAAELKIGDDFLKAKCLMNCEVALILEHKYEQLQQMSDDPMNQVSQVFEKSLQYVKRFSRYKNPDALCVLGNLCPETVEEAIAMVPSIKTKGRAHDDEAIEKMLNDLSLIKKFE

SEQ ID NO: 462 - DNA, 733 bp, Panicum virgatum
  misc_feature: Ceres CLONE ID no.1772747
  misc_feature: Encodes the peptide sequence at SEQ ID NO 463
atcgccgcgcttcccccaccaatcccttccgttgttgaatcgagtcgagtccaatcgcaggcagcagcaatccccaactccgtcgtcgtctccagcgatctcgctccgttcggaagcagcaagatgtccggcgaggaggaggagaacgccgccgagctcaagatcggagaagagttcctcaaggccaagtgcctgatgaactgcgaggtggccatcatcctggagcacaagttcgagcagatccagcagcacgcgtcggactcggacccctcgtcgcaggtgtcgcaggtgttcgagaagtcgctgcagtacgtgaagcgcttcagccgctacaagaaccccgacgccgtgcgccaggtccgcgagacgctcagccgctacggcctcgccgagttcgagctctgcaccatcggcaacctctgccccgacaccagcggcgaggccaccgcgctcgtcccttccctcaagtccgggggcaggttcgtcggcgaccaaggcgacgagaagatcgagaagatgctcaacgacctctccctcatcaagaagttcgagtagctgcctctagctgcttttgctattgtcatgacatggccgtgccttgttcagttggtccgtcaatttcccctagctgccttatatcttgtcacatcaggcgacaactcaagatcagtatgtaacttatttcctaatgattcatctttgtaactctcaacaaaaaaaaaaaaaaaaaaaa

SEQ ID NO: 463 - protein, 143 aa, Panicum virgatum
  misc_feature: Ceres CLONE ID no.1772747
  misc_feature: Bit score of 362.6 for HMM based on sequences of FIGURE 1.
  misc_feature (19)..(140): Pfam Name: RNA_pol_Rpb4 Pfam Description: RNA polymerase Rpb4
  misc_feature: Functional Homolog Of Ceres SEEDLINE ID no. ME00029 at SEQ ID NO. 442
MSGEEEENAAELKIGEEFLKAKCLMNCEVAIILEHKFEQIQQHASDSDPSSQVSQVFEKSLQYVKRFSRYKNPDAVRQVRETLSRYGLAEFELCTIGNLCPDTSGEATALVPSLKSGGRFVGDQGDEKIEKMLNDLSLIKKFE

SEQ ID NO: 464 - DNA, 681 bp, Zea mays
  misc_feature: Ceres CLONE ID no.225960
  misc_feature: Encodes the peptide sequence at SEQ ID NO 465
aaatcgcaattcgcaattcccagccccattccccgtcgcccggtcggaagcaccaccagctaccagggatgtctggcgaggaggaggagaacgccgcggagctcaagatcggcgaagagttcctcaaggccaagtgcctgatgaactgcgaggtggcgatcatcctggagcacaagtacgagcagatccagcagcacgcgtcgtcggagtcggacccgtcgtcgcaggtgtcgcaggtgttcgagaagtcgctgcagtacgtgaagcgcttcagccgctacaagaaccccgacgccgtgcgccaggtccgcgagacgctgagccgctacggcctcgccgagttcgagctctgcacgctcggcaacctctgccccgacaccagcggcgaggccaccgcgctcgtcccctccctcaagtccggcggcaggttcgtcggcgaccccggggacgagaagatcgagaagatgctcaacgacctctccctcatcaagaagttcgagtagagcgggagcccccagggtccgtatctcccccctcttctcttcttttctcttggagtagcgagcatccagagaggaggggaattcaacatcaagacgatgtactgctaaaattttacttgccttactactatcgttgaggtttgcgtctgcgtattgattagaaccttgtttgatcgat

SEQ ID NO: 465 - protein, 144 aa, Zea mays
  misc_feature: Ceres CLONE ID no.225960
  misc_feature: Bit score of 363.5 for HMM based on sequences of FIGURE 1.
  misc_feature (19)..(141): Pfam Name: RNA_pol_Rpb4 Pfam Description: RNA polymerase Rpb4
  misc_feature: Functional Homolog Of Ceres SEEDLINE ID no. ME00029 at SEQ ID NO. 442
MSGEEEENAAELKIGEEFLKAKCLMNCEVAIILEHKYEQIQQHASSESDPSSQVSQVFEKSLQYVKRFSRYKNPDAVRQVRETLSRYGLAEFELCTLGNLCPDTSGEATALVPSLKSGGRFVGDPGDEKIEKMLNDLSLIKKFE

SEQ ID NO: 466 - DNA, 1221 bp, Populus balsamifera subsp. trichocarpa
  misc_feature: Ceres ANNOT ID no.1443434
  misc_feature: Encodes the peptide sequence at SEQ ID NO 467
atgacaaaccagaatgtggttgtgcctgatgccaaacagggtattgatatcaccatcgcaatggtgctgcccaagtctctgttttcacctgttgtgccaaagccattgcctgccgctcctggtgggtatttcacaataacccgaaagaggttctcgaagaagacagaaactggaggcaaaatcagttcctgggttgattctatgagggattcttcacctacccgtgtcaaatccaccacttctttatcagaaactgaagagaaaaattcttggattgtaaaccatccttctgctctgaacatgtttgagcaaatagtgaaaggctcaaagggaaagcagattgtgatgttccttgattatgatggtacactgtcacccattgttgaagatcctgacagagcattcatgaccaatgagatgagagaagctgtcagggacgttgctagatactttcccacggctatagtgacgggaaggtgtagaaaaaaggtatctcttgcggctgctgctgttgttattttgaaagtgtatagctttgtaagattggcagggctttattatgctggtagccatggcatggacatcaagggaccatccaaaaataattgcaaatacgaaaaaggtggtgtactctttcaacctgccagtgaatttttacccatgattgatgaggtgtacaatgtcttgttggagagaacaaaatctatcccaggagctaaagtagaaaacaacaaattttgcgtatccgtacactttcgatgtgttgaggaaaagatgtgggctatattagtagagcaagtccgatcagttctcaatgattatcccaagcttagattaactcaagggaggaaggttttagagatccgacccaccattaaatgggacaagggcaaagctcttgaattcttgttagagtcattaggatatgccaattctactgacgtttttccggtctatattggagatgatcgaactgatgaggacgcattcaaggttctaagaaacagggggcaagggcttgggattcttgtttctaaagttcccaaggaaacaaatgcctcttattctctacaggaaccaaaagaggcaagttctttaatgttaaagacttcttacggcgattggtggagtggaagcgatcttcgttacaaggacaacgtagagcgtaaaaatatattagatcaagacccttgcctaaacgttggtcgagggtggccttga

SEQ ID NO: 467 - protein, 386 aa, Populus balsamifera subsp. trichocarpa
  misc_feature: Ceres ANNOT ID no.1443434
  misc_feature: Bit score of 594.2 for HMM based on sequences of FIGURE 9.
  misc_feature (97)..(341): Pfam Name: Trehalose_PPase Pfam Description: Trehalose-phosphatase
  misc_feature: Functional Homolog Of Ceres SEEDLINE ID no. ME20095 at SEQ ID NO. 1129
MVLPKSLFSPVVPKPLPAAPGGYFTITRKRFSKKTETGGKISSWVDSMRDSSPTRVKSTTSLSETEEKNSWIVNHPSALNMFEQIVKGSKGKQIVMFLDYDGTLSPIVEDPDRAFMTNEMREAVRDVARYFPTAIVTGRCRKKVSLAAAAVVILKVYSFVRLAGLYYAGSHGMDIKGPSKNNCKYEKGGVLFQPASEFLPMIDEVYNVLLERTKSIPGAKVENNKFCVSVHFRCVEEKMWAILVEQVRSVLNDYPKLRLTQGRKVLEIRPTIKWDKGKALEFLLESLGYANSTDVFPVYIGDDRTDEDAFKVLRNRGQGLGILVSKVPKETNASYSLQEPKEASSLMLKTSYGDWWSGSDLRYKDNVERKNILDQDPCLNVGRGWP

SEQ ID NO: 468 - DNA, 571 bp, Zea mays
  misc_feature: Ceres CLONE ID no.1437889
  misc_feature: Encodes the peptide sequence at SEQ ID NO 469
caatcgcaattcgcaattcccagccccattccccgtcgcccggtcggaagcaccaccagctaccagggatgtctggcgaggaggaggagaacgccgcggagctcaagatcggcgaagagttcctcaaggccaagtgcctgatgaactgcgaggtggcgatcatcctggagcacaagtacgagcagatccagcagcacgcgtcgtcggagtcggacccgtcgtcgcaggtgtcgcaggtgttcgagaagtcgctgcagtacgtgaagcgcttcagccgctacaagaaccccgacgccgtgcgccaggtccgcgagacgctgagccgctacggcctcgccgagttcgagctctgcacgctcggcaacctctgccccgacaccagcggcgaggccaccgcgctcgtcccctccctcaagtccggcggcaggttcgtcggcgaccccggggacgagaagatcgagaagatgctcaacgacctctccctcatcaagaagttcgagtagagcgggagccctctcttctcttatcttctcttctcttggagtagcgagcatccagagaggaggggaat

SEQ ID NO: 469 - protein, 144 aa, Zea mays; identical to SEQ ID NO: 465
  misc_feature: Ceres CLONE ID no.1437889
  misc_feature: Bit score of 363.5 for HMM based on sequences of FIGURE 1.
  misc_feature (19)..(141): Pfam Name: RNA_pol_Rpb4 Pfam Description: RNA polymerase Rpb4
  misc_feature: Functional Homolog Of Ceres SEEDLINE ID no. ME00029 at SEQ ID NO. 442

SEQ ID NO: 470 - protein, 142 aa, Oryza sativa subsp. japonica
  misc_feature: Public GI ID no.115443807
  misc_feature: Bit score of 368.7 for HMM based on sequences of FIGURE 1.
  misc_feature (19)..(139): Pfam Name: RNA_pol_Rpb4 Pfam Description: RNA polymerase Rpb4
  misc_feature: Functional Homolog Of Ceres SEEDLINE ID no. ME00029 at SEQ ID NO. 442
MSGEEEENAAELKIGEEFLKAKCLMNCEVAIILEHKYEQIQHMSDGDPSSQVSQVFEKSLQYVKRFSRYKNPDAVRQVRETLSRYGLAEFELCTLGNLCPDTSDEASALVPSLRSGGRFVGDPGSEKIDKMLNDLSLIKKFE

SEQ ID NO: 471 - DNA, 555 bp, Panicum virgatum
  misc_feature: Ceres CLONE ID no.2014249
  misc_feature: Encodes the peptide sequence at SEQ ID NO 472
gttcaatcgagtcgagtccaatcgcatcgcagcaattccaactccggcgatctcgctccggtcggaagcagcaagatgtccggcgaggaggaggagaacgccgccgagctcaagatcggagaagagttcctcaaggccaagtgcctgatgaactgcgaggtggccatcatcctggagcacaagtacgagcagatccagcagcacgcgtcggactcggacccctcgtcgcaggtgtcgcaggtgttcgagaagtcgctgcagtacgtcaagcgcttcagccgctacaagaaccccgacgccgtgcgccaggtccgcgagacgctcagccgctacggcctcgccgagttcgagctctgcaccatcggcaacctctgccccgacaccagcggcgaggccaccgcgctcgtcccttccctcaagtccgggggcaggttcgacggcgacgccggcgacgagaagatgctcaacgacctctccctcatcaagaagttcgagtagccagctctagtgccatctgccgcagtcttgctatattgccatggccatgccttttgt

SEQ ID NO: 472 - protein, 140 aa, Panicum virgatum
  misc_feature: Ceres CLONE ID no.2014249
  misc_feature: Bit score of 357.6 for HMM based on sequences of FIGURE 1.
  misc_feature (19)..(137): Pfam Name: RNA_pol_Rpb4 Pfam Description: RNA polymerase Rpb4
  misc_feature: Functional Homolog Of Ceres SEEDLINE ID no. ME00029 at SEQ ID NO. 442
MSGEEEENAAELKIGEEFLKAKCLMNCEVAIILEHKYEQIQQHASDSDPSSQVSQVFEKSLQYVKRFSRYKNPDAVRQVRETLSRYGLAEFELCTIGNLCPDTSGEATALVPSLKSGGRFDGDAGDEKMLNDLSLIKKFE

SEQ ID NO: 473 - DNA, 685 bp, Panicum virgatum
  misc_feature: Ceres CLONE ID no.2033133
  misc_feature: Encodes the peptide sequence at SEQ ID NO 474
gagtcgagtccaatcgcaggcagcagcaatccccaactccgtcgtcgtctccagcgatctcgctccgttcggaagcagcaagatgtccggcgaggaggaggagaacgccgccgagctcaagatcggagaagagttcctcaaggccaagtgcctgatgaactgcgaggtggccatcatcctggagcacaagtacgagcagatccagcagcacgcgtcggactcggacccctcgtcgcaggtgtcgcaggtgttcgagaagtcgctgcagtacgtgaagcgcttcagccgctacaagaaccccgacgccgtgcgccaggtccgcgagacgctcagccgctacggcctcgccgagttcgagctctgcaccatcggcaacctctgccccgacaccagcggcgaggccaccgcgctcgtcccttccctcaagtccgggggcaggttcgtcggcgaccaaggcgacgagaagatcgagaagatgctcaacgacctctccctcatcaagaagttcgagtagctgcctctagctgccttatatcttgttcagttggtccgtcagtttcccctagctgccttatatcttgtcacatcaggcgacaactcaagatcagtatgtaacttatttcctaatgattcatctttgtaactctcaacaaaaagggcctttgatgatgttgctttcctgttc

SEQ ID NO: 474 - protein, 143 aa, Panicum virgatum
  misc_feature: Ceres CLONE ID no.2033133
  misc_feature: Bit score of 364.0 for HMM based on sequences of FIGURE 1.
  misc_feature (19)..(140): Pfam Name: RNA_pol_Rpb4 Pfam Description: RNA polymerase Rpb4
  misc_feature: Functional Homolog Of Ceres SEEDLINE ID no. ME00029 at SEQ ID NO. 442
MSGEEEENAAELKIGEEFLKAKCLMNCEVAIILEHKYEQIQQHASDSDPSSQVSQVFEKSLQYVKRFSRYKNPDAVRQVRETLSRYGLAEFELCTIGNLCPDTSGEATALVPSLKSGGRFVGDQGDEKIEKMLNDLSLIKKFE

SEQ ID NO: 475 - DNA, 461 bp, Glycine max
  misc_feature: Ceres CLONE ID no.707404
  misc_feature: Encodes the peptide sequence at SEQ ID NO 476
gaatctctcgttcgattcttggcattccacttctcgccctcgttctttttttgcgttttcttcttcttcttcttcttcttcttcttcttcttctcactttttacctaagattttgtggaacatgtccggggaagaggaagaaaacgccgcagagctcaaaattggagacgagtttttgaaggcaaagtgcttaatgaactgtgaagtttcattgattcttgagcacaagtatgagcagcttcaacagacatctgatgatcccatgaatcaaatttctcaggtatttgaaaagtcactgcagtatgtgaaacgtttcagtcgctataaaaatcctgatgctgtcagacaagttcgaaaaattctcgcaagatatcaattggctgagtttgagttgtgtgtccttggcaacctttgcccagaaactgtggaggaagctattgctatggttccatctatcaagt

SEQ ID NO: 476 - protein, 113 aa, Glycine max
  misc_feature: Ceres CLONE ID no.707404
  misc_feature: Bit score of 272.2 for HMM based on sequences of FIGURE 1.
  misc_feature (19)..(111): Pfam Name: RNA_pol_Rpb4 Pfam Description: RNA polymerase Rpb4
  misc_feature: Functional Homolog Of Ceres SEEDLINE ID no. ME00029 at SEQ ID NO. 442
MSGEEEENAAELKIGDEFLKAKCLMNCEVSLILEHKYEQLQQTSDDPMNQISQVFEKSLQYVKRFSRYKNPDAVRQVRKILARYQLAEFELCVLGNLCPETVEEAIAMVPSIK

SEQ ID NO: 477 - DNA, 854 bp, Panicum virgatum
  misc_feature: Ceres CLONE ID no.1770680
  misc_feature: Encodes the peptide sequence at SEQ ID NO 478
aatcgagtcgagtccaatcgcatcgcagcaattccaactccggcgatctcgctccggtcggaagcagcaagatgtccggcgaggaggaggagaacgccgccgagctcaagatcggagaagagttcctcaaggccaagtgcctgatgaactgcgaggtggccatcatcctggagcacaagtacgagcagatccagcggcacgcgtcggactcggacccctcgtcgcaggtgtcgcaggtgttcgagaagtcgctgcagtacgtcaagcgcttcagccgctacaagaaccccgacgccgtgcgccaggtccgcgagacgctcagccgctacggcctcgccgagttcgagctctgcaccatcggcaacctctgccccgacaccagcggcgaggccaccgcgctcgtcccttccctcaagtccgggggcaggttcgacggcgacgccggcgacgagaagatcgagaagatgctcaacgacctctccctcatcaagaagttcgagtagccagctctagtgccatctgccgcagtcttgctatattgccatggccatgccttttgttcacttggaccgtcagttcccctggctgccctgccttgtcacatcaggctccatgctaatgatcagcaatgattcatctttgtaactctgaacaaaaagcctccatgctgcgaatttgagaactcaagagagggcctttgatgatgatgttgctttccctgttctttggacgtctcataaaagtagcagtgctacatctattactgctggtatgaacatgaagcttaaaagggaacattccagatgaagatgtacttgaatttcttatcaaaaaaaaaaaaaaaaaaaaaaaaa

SEQ ID NO: 478 - protein, 143 aa, Panicum virgatum
  misc_feature: Ceres CLONE ID no.1770680
  misc_feature: Bit score of 362.3 for HMM based on sequences of FIGURE 1.
  misc_feature (19)..(140): Pfam Name: RNA_pol_Rpb4 Pfam Description: RNA polymerase Rpb4
  misc_feature: Functional Homolog Of Ceres SEEDLINE ID no. ME00029 at SEQ ID NO. 442
MSGEEEENAAELKIGEEFLKAKCLMNCEVAIILEHKYEQIQRHASDSDPSSQVSQVFEKSLQYVKRFSRYKNPDAVRQVRETLSRYGLAEFELCTIGNLCPDTSGEATALVPSLKSGGRFDGDAGDEKIEKMLNDLSLIKKFE

SEQ ID NO: 479 - DNA, 432 bp, Populus balsamifera subsp. trichocarpa
  misc_feature: Ceres ANNOT ID no.1450989
  misc_feature: Encodes the peptide sequence at SEQ ID NO 480
atgtcaggagaagaggaagagaatgcggccgagctcaaaatcggagatgattttttgaaagccaagtgcttaatgaattgtgaagttgctttaattcttgagcataagtatgagcagcttcaacagatgtctgatgatcctatgaatcaagtatcccagtttagtttaaatcatgaatgtaggaactgggaggtctttgatgcaatgttttggagagtatttgagaaatcactgcagtatgtgaaacgctttagtcgctataaaaatcccgatgctgtcagacaactttgtgttcttggcaacctttgcccggaaacagtcgaggaagctattgccatggtaccttctatcaagaccaaaggccgagctcacgatgatgaagcaattgagaaaatgttgaatgacctgtcattgatcaagaaattcgaatag

SEQ ID NO: 480 - protein, 143 aa, Populus balsamifera subsp. trichocarpa
  misc_feature: Ceres ANNOT ID no.1450989
  misc_feature: Bit score of 288.8 for HMM based on sequences of FIGURE 1.
  misc_feature (19)..(140): Pfam Name: RNA_pol_Rpb4 Pfam Description: RNA polymerase Rpb4
  misc_feature: Functional Homolog Of Ceres SEEDLINE ID no. ME00029 at SEQ ID NO. 442
MSGEEEENAAELKIGDDFLKAKCLMNCEVALILEHKYEQLQQMSDDPMNQVSQFSLNHECRNWEVFDAMFWRVFEKSLQYVKRFSRYKNPDAVRQLCVLGNLCPETVEEAIAMVPSIKTKGRAHDDEAIEKMLNDLSLIKKFE

SEQ ID NO: 481 - protein, 128 aa, Brassica rapa subsp. pekinensis
  misc_feature: Public GI ID no.72384445
  misc_feature: Bit score of 274.7 for HMM based on sequences of FIGURE 1.
  misc_feature (19)..(125): Pfam Name: RNA_pol_Rpb4 Pfam Description: RNA polymerase Rpb4
  misc_feature: Functional Homolog Of Ceres SEEDLINE ID no. ME00029 at SEQ ID NO. 442
MSGEEEENAAELKIGDEFLKAKCLMNCEVSLILEHKVFEKSLQYVKRFSRYKNPDAVRQHVYLNSSFHRILSRHQLTEFELCVLGNLCPETAEEAVAMVPSLKTKGRAHSDEAIEKMLNDLSLVKRFE

SEQ ID NO: 482 - DNA, 674 bp, Triticum aestivum
  misc_feature: Ceres CLONE ID no.569388
  misc_feature: Encodes the peptide sequence at SEQ ID NO 483
gagtttacccgacgccaccccctcttttctttcccccttcctcttcaactcccgtctcacctctcccgacgccgaaccgaatcgcagcagcggcagccggagaagaagagatcgagcgccagcagccatgtccggcatggaggaggaggagaacgccgccgagctcaagatcggcgaagagttcctgaaggccaagtgcctgatgaactgcgaggtggcgataatcctggagcacaagtgggagcagctgcagcacatgtcggacggcggcgccgaccaggtctcgcaggtcttcgagaagtcgcaggcctacgtcaagcgcttcagccgctacaagaaccccgacgcggtccgccaggtccgcgagacgctctcccgctacagcctcgtcgagttcgagctctgcaccctcgggaacctctgccccgacaccgccgacgaggccaaggcgctcgtcccctccctcgtccccggcggcaggttcgacagcgacgaccgggtcgacaagatgctcaacgacctctccctcatcaagaagttcgagtagtagcccccataatatgctcttcttgtcttcctccagtgatatgtttaagcttcagattatctccttttattgcgctatgatcataagacatcagtgtcagtctcaaatgaatggagttaattaaacc

SEQ ID NO: 483 - protein, 139 aa, Triticum aestivum
  misc_feature: Ceres CLONE ID no.569388
  misc_feature: Bit score of 362.0 for HMM based on sequences of FIGURE 1.
  misc_feature (20)..(136): Pfam Name: RNA_pol_Rpb4 Pfam Description: RNA polymerase Rpb4
  misc_feature: Functional Homolog Of Ceres SEEDLINE ID no. ME00029 at SEQ ID NO. 442
MSGMEEEENAAELKIGEEFLKAKCLMNCEVAIILEHKWEQLQHMSDGGADQVSQVFEKSQAYVKRFSRYKNPDAVRQVRETLSRYSLVEFELCTLGNLCPDTADEAKALVPSLVPGGRFDSDDRVDKMLNDLSLIKKFE

SEQ ID NO: 484 - DNA, 821 bp, Glycine max
  misc_feature: Ceres CLONE ID no.1059299
  misc_feature: Encodes the peptide sequence at SEQ ID NO 485
ccccttcctcttcccctccccccatctcctcccccgacgccgaaccgaatcgccgcagcagccgccggagaagaacaaattgagcgccagcagccatgtccggcgtggaggaggaggagaacgccgccgagctcaagatcggcgaagagttcctcaaggccaagtgcctgatgaactgcgaggtggcgataatcctggagcacaagtgggagcagctgcagcacatgtcggacggcggcgccgaccaggtctcgcaggtgttcgagaagtcgcaggcctacgtcaagcgcttcagccgctacaagaaccccgacgcggtccgccaggtccgcgagacgctctcccgctacagcctcgtcgagttcgagctctgcaccctggggaacctctgccccgacaccgccgacgaggccaaggcgctcgtcccctccctcgtccccggcggcaggttcgacagcgacgaccgcgtcgacaagatgctcaacgacctctccctcatcaagaagttcgagtagctcttcttgtgttcctccaatggacatgatggacatggagaccatgtgtcatttatcagtctcaagaagtacttactagctactagtagcctagtttggtgatatgtttaatcttcagattatctcctcctatgctatgatcataaagcatcagcagtgtcaatctcaaatgtatggagttgattaaaccttgttgttatgctgtcttggagaaaaatgtagcagcttcttgttggagatatatggagtttacgctcctatatgctatgactataagacggagttgattaaacatttgttgatatc

SEQ ID NO: 485 - protein, 139 aa, Glycine max
  misc_feature: Ceres CLONE ID no.1059299
  misc_feature: Bit score of 360.3 for HMM based on sequences of FIGURE 1.
  misc_feature (20)..(136): Pfam Name: RNA_pol_Rpb4 Pfam Description: RNA polymerase Rpb4
  misc_feature: Functional Homolog Of Ceres SEEDLINE ID no. ME00029 at SEQ ID NO. 442
MSGVEEEENAAELKIGEEFLKAKCLMNCEVAIILEHKWEQLQHMSDGGADQVSQVFEKSQAYVKRFSRYKNPDAVRQVRETLSRYSLVEFELCTLGNLCPDTADEAKALVPSLVPGGRFDSDDRVDKMLNDLSLIKKFE

SEQ ID NO: 486 - DNA, 432 bp, Sorghum bicolor
  misc_feature: Ceres ANNOT ID no.6008086
  misc_feature: Encodes the peptide sequence at SEQ ID NO 487
atgtccggcgaggaggaggagaacgccgcggagctcaagatcggcgaagagtttctcaaggccaagtgcctgatgaactgcgaggtggcgatcatcctggagcacaagtacgagcagatccagcagcactcgtcggagtcggacccgtcgtcgcaggtgtcgcaggtgttcgagaagtcgctgcagtacgtgaagcgcttcagccgctacaagaaccccgacgccgtgcgccaggtccgcgagacgctcagccgctacggactcgccgagttcgagctctgcacgctcggcaacctctgccccgacaccagcggcgaggccaccgcgctcgtcccgtccctcaagtccggcggcaggttcgtcggagacgccagggacgagaagatcgagaagatgctcaacgacctctccctcatcaagaagttcgagtag

SEQ ID NO: 487 - protein, 143 aa, Sorghum bicolor
  misc_feature: Ceres ANNOT ID no.6008086
  misc_feature: Bit score of 364.1 for HMM based on sequences of FIGURE 1.
  misc_feature (19)..(140): Pfam Name: RNA_pol_Rpb4 Pfam Description: RNA polymerase Rpb4
  misc_feature: Functional Homolog Of Ceres SEEDLINE ID no. ME00029 at SEQ ID NO. 442
MSGEEEENAAELKIGEEFLKAKCLMNCEVAIILEHKYEQIQQHSSESDPSSQVSQVFEKSLQYVKRFSRYKNPDAVRQVRETLSRYGLAEFELCTLGNLCPDTSGEATALVPSLKSGGRFVGDARDEKIEKMLNDLSLIKKFE

SEQ ID NO: 488 - DNA, 1463 bp, Arabidopsis thaliana
  misc_feature: Ceres SEEDLINE ID no.ME00045
  misc_feature: Encodes the peptide sequence at SEQ ID NO. 489
ccggcgacacttcccttgcttctccctcttaggactctctctacgaatctgtaagcttcaaattcttacgccacactccgagattcgcttctgattattgtatgaatttttgagctccaaggatccactgccatgtatttatgctgctaaagcttgaaggcagtagttgaatcaccattaagttctttgctttgtaatttagcttgatttgagaataaacaaatgggaaaagcatcaggcttgcttctgtttctcttgggttttgggttctttgttgtcacatataatcttctgacacttatagttcacaatagatctggtgtgagtaattcagatggaagtccacttctggatcctgttgttcagatgcctctaaatattaggaaagccaagagttctccagcaccttttcatgttgccttaacagctacagatgcaccttataataagtggcagtgtcgtattatgtattattggtataagcagaagaaagctcttcctggttctgatatgggtggcttcacccgtattttgcattccggtaattctgataacttgatggatgaaatacccacatttgtggttgatcctcttcctccaggtcttgatcgggggtatgttgtcttgaatagaccatgggcattcgtgcaatggcttgaaagagctaccatcaaggaagactatgtgctcatggcagagcctgatcatgtatttgttaatccccttcccaatttggctgttggaggattcccagccgcttttccgtttttctatattactcctgaaaagtatgaaaacatagtcagaaagtattatccagcggagatggggccagtaacaaatatcgaccccattggcaactctcctgttatcataagcaaggaatcacttgaaaagattgctcctacatggatgaatgtctcgctgacaatgaaaaacgatccagaaactgataaggcatttggatgggtgctggaaatgtacggttacgcaattgcatctgctatacatggggtgcgtcacatacttcggaaggatttcatgcttcagcctccgtgggatttgtctaccaaggggaagtttatcattcattacacttatggatgcgactacaacatgaagggggagctgacatatggcaaaataggagagtggcgattcgataagagatcacatttgcggggtcctcctccaaggaacatgtccttgccgcctcccggtgttcccgaaagtgtggtgacacttgtgaagatggtgaatgaagctactgcgactatccctaattgggacactctctaactcacatccacacacaaaacacaaaccatagggacaaatccatacagcaacaatattttgcctaatttttttttccttctccctttacttccctgtctgttttttcttgtaatggttaaattatgaacttgagtagtaaattacaaaattatttgtttgacacc

SEQ ID NO: 489 - protein, 358 aa, Arabidopsis thaliana
  misc_feature: Ceres SEEDLINE ID no.ME00045
  misc_feature: Bit score of 930.3 for HMM based on sequences of FIGURE 2.
MGKASGLLLFLLGFGFFVVTYNLLTLIVHNRSGVSNSDGSPLLDPVVQMPLNIRKAKSSPAPFHVALTATDAPYNKWQCRIMYYWYKQKKALPGSDMGGFTRILHSGNSDNLMDEIPTFVVDPLPPGLDRGYVVLNRPWAFVQWLERATIKEDYVLMAEPDHVFVNPLPNLAVGGFPAAFPFFYITPEKYENIVRKYYPAEMGPVTNIDPIGNSPVIISKESLEKIAPTWMNVSLTMKNDPETDKAFGWVLEMYGYAIASAIHGVRHILRKDFMLQPPWDLSTKGKFIIHYTYGCDYNMKGELTYGKIGEWRFDKRSHLRGPPPRNMSLPPPGVPESVVTLVKMVNEATATIPNWDTL

SEQ ID NO: 490 - protein, 416 aa, Vitis vinifera
  misc_feature: Public GI ID no.147844794
  misc_feature: Bit score of 796.2 for HMM based on sequences of FIGURE 2.
  misc_feature: Functional Homolog Of Ceres SEEDLINE ID no. ME00045 at SEQ ID NO. 489
MARISPLFLVVLSLGFFFATYNLLTMTIHNRATGTLVVDESDHRLLSDPIIEMPENVRKPKNAKLPFHIALTATDAPYSKWQCRIMYYWYKKKKDLPGSEMGGFTRILHSGSPDNLMEEIPTFVVDPLPAGLDRGADVVIPTFVFLNGLGYIVLNRPWAFVQWLEKATIEEEYILMAEPDHIFIKPLPNLAHGDYPAAYPFFYIKPVQNEKIIRKFYPEEHGPVTNVDPIGNSPVIIKRMMMMLAFYFVLTFSGGTGVVGEDCAYMDEFSVSLRMKDDPETDKVFGWVLEMYAYAVASALHGVQHILQKDFMLQPPWDLETAKKFIIHYTYGCDYNLKGELTYGKIGEWRFDKRSYLRGPPPRNLSLPPPGVPESVLDSWSYNSLTPYRAQDKLRKVTLVKMVNEATANLPRWDTQ

SEQ ID NO: 491 - protein, 198 aa, Vitis vinifera
  misc_feature: Public GI ID no.147842279
  misc_feature: Bit score of 261.3 for HMM based on sequences of FIGURE 2.
  misc_feature: Functional Homolog Of Ceres SEEDLINE ID no. ME00045 at SEQ ID NO. 489
MAEPDHIFVNPLPNLAHGGHPAGFPFFYIKPADNEKIIRKFYPKEKGPVTDVDPIGNSPVIIEKSQLEEIAPTWMNISLRMKDDPETDKAFGWVLEMYAYAVASALHGVQHILRKDFMLQPPWDLEVGKKFIIHYTYGCDYNLKGELTYGKIGEWRFDKRSFLSGPPPKNLTLPPPGVPEKCAQFISFLASFCMDCKL

SEQ ID NO: 492 - protein, 318 aa, Ostreococcus lucimarinus CCE9901
  misc_feature: Public GI ID no.145355441
  misc_feature: Bit score of 331.8 for HMM based on sequences of FIGURE 2.
  misc_feature: Functional Homolog Of Ceres SEEDLINE ID no. ME00045 at SEQ ID NO. 489
MRGDPDPSRKFHVVMTTNNAVYQGWQARVMYYHFQKQKAAQGPNGQMGGFTRVLHDVADGLEDEIPTCIVDRLEDELGFVVLSRPFAFVQFFEKCPQIEEDFILMAEPDHLYIKPVPNLMRGDTPAAFPFFYINPKEKPDIVRRFLPGITDEEMKDIDGIGSSPVFIRKDDLERLAPAWAEMSVALQKDKDAKAAWGWVIEMYGYTLAAYKLGISHDLRPQMAAQPPWDKAVGDFISIHFTYGMDYDLDGVFTPGKIGAWRFDKRSYSHAYPPKKIPDPPKGMNNDLVRALVDAVNEASAALPDWGKWGTENVIAGFN

SEQ ID NO: 493 - DNA, 1630 bp, Glycine max
  misc_feature: Ceres CLONE ID no.571200
  misc_feature: Encodes the peptide sequence at SEQ ID NO 494
agggaagaaccactaccaaacttcaactcactttctctctctcattctccctctctctcaccccctccgatctataaatcattctctctctctctctctctctcttacttacaaagtaaagagtagagtttgttctgtgaagaactgagggaggttcaggtccatgatattttgaaatctctctgtagtaggaagaccatgggacgagcttcatcattacttataatttttttggttcttggttcttcctttgccacctataatgtggtaacgatgataaggcactacggatcttcagaaggtgtggctgttaatgatggtgcattgttttttgaccctattactgagatgcctgatcatgtaaagaatcggaagacatctaaagtgccctttcatgtcgcgttaacggcgacggatgctccatataacaaatggcagtgccgcgtcatgtattactggtataaacaacaaaagaagttacctgggtctgagatgggaggattcacgaggattctacattctggaaatcctgacaacttgatggatgaaattcctactgttgtggttgatccccttccagcaggtttggatcggggatacattgttctgaataggccatgggcctttgttcagtggctggaaaagactaaaatagaggaagaatatgtgttaatggcagagcccgatcacatatttgtgcgtcctctgcccaatctggcctatggaggacatccggctgcttttccatttttttacattagacctgatgagaatgaaaaaatcataaggaagttttatcctgaggagctgggaccagttacaaatgttgatccaattggaaattcgcctgtaattataagaaaggatttgattgcaaagattgcccccacatggatgaatatttctttgaagatgaaagaggatccagagactgataaagcttttggatgggtgctagaaatgtatgcttatgctgttgcatctgctctgcatggtgtgaggcacattctgcggaaagacttcatgctgcagcccccatgggatcttgaaactaacaagaagtacattatacattacacttacggatgtgactacaatatgaagggtgaattgacttatggcaaagttggtgaatggagatttgacaaaaggtcgcatctacgaggacctccaccaaaaaacttgcccctgcccccaccaggggttcctgaaagtgtggtaacccttgtaaagatggtgaacgaggctagtgctaacatcccaaattgggacacatcgtaaatattttccacctcatcatgatgatatcccaagtgcacattttaaaaagaaaaaaaattgacaatgagtctttttttttttttttttatcacgagtttagtcttattagatggatagatgaatgtaagcaataccattttatatgacaattaaatacaggataaatatttatatttttttttcttgttggtgatatttttgaatggtatttgggctcgtaccacaatggctgatactttgttcattaagtattggcttcgaaattgcttatgtatatgttagacaattcttgtattgtatgccatgcatagccctagacaacataataattgtttctcttcatttctac

SEQ ID NO: 494 - protein, 360 aa, Glycine max
  misc_feature: Ceres CLONE ID no.571200
  misc_feature: Bit score of 937.8 for HMM based on sequences of FIGURE 2.
  misc_feature: Functional Homolog Of Ceres SEEDLINE ID no. ME00045 at SEQ ID NO. 489
MGRASSLLIIFLVLGSSFATYNVVTMIRHYGSSEGVAVNDGALFFDPITEMPDHVKNRKTSKVPFHVALTATDAPYNKWQCRVMYYWYKQQKKLPGSEMGGFTRILHSGNPDNLMDEIPTVVVDPLPAGLDRGYIVLNRPWAFVQWLEKTKIEEEYVLMAEPDHIFVRPLPNLAYGGHPAAFPFFYIRPDENEKIIRKFYPEELGPVTNVDPIGNSPVIIRKDLIAKIAPTWMNISLKMKEDPETDKAFGWVLEMYAYAVASALHGVRHILRKDFMLQPPWDLETNKKYIIHYTYGCDYNMKGELTYGKVGEWRFDKRSHLRGPPPKNLPLPPPGVPESVVTLVKMVNEASANIPNWDTS

SEQ ID NO: 495 - DNA, 1515 bp, Gossypium hirsutum
  misc_feature: Ceres CLONE ID no.1928532
  misc_feature: Encodes the peptide sequence at SEQ ID NO 496
acaaaatctctctcagataactgtctcaagatttccttgatctccatcctttctggtaattcttggagcttgcattctcctgttagtgtactccaactaatggtgtagtggcttttttccattgtcaaccggtgtgggcgtttttgcggtgtagagctcgtttttaagcagtttggactttggaggatcggagatcgtggtcgatgatatcgagaaagaacatgggaagtgcttcgccgctcctactcattacattagttcttggtgtttgctttgccacatataatcttgtaacaatggtaatgcacaatagatctatttcaaaactgacaatctataactccgatggtggaatatttgttgatcccatcattgagatgcccgaaagtgtgaggaaattgaagcgtgccaaaatgcctttccatgttgccttaactgccactgatgctccctacagcaaatggcagtgtcgtatcatgtactattggtataagaagcagaaggacttacctgggtcggagatgggaggtttcactcgtattttacactctggaaatcctgacaatttgatgaacgagattcctactgtcatagtcgatcctcttccagcagggcttgatcggggatacatcgtcttaaatcgaccatgggcttttgtgcaatggctggaaaaggctacaattgaagaagaatacgtattgatggcagagcctgaccacatttttgtcactcccctacctaatctagcacatggaggatacccggctgcattcccctttttctacattaagccggatcagaacgaaaagttgttaaggaagtttttcccggaggagatgggaccggtgacaaatattgatccaatcggcaattcacccgtcattatcaagaaggaattattggaaaaaatcgctcctacttggatgaatgtttctttaaaaatgaaggatgatcccgagactgataaaacttttggatgggtgctagaaatgtatgcttatgctgtggcatcggctttgcatggcgtgcaacatgtacttcaaaaagacttcatgcttcagcaaccgtgggatctggaagtagggaaaaagtacataattcattacacctatggatgtgactacaacatgaagggtgagttaacatatggtaaaatcggtgagtggcgatttgacaagagatcgtttctacgaggaccaccaccacgaaatctccccttgcctcctccaggggtcccagaaagcgtggtgacgcttgtgaagatggtgaacgaagcaacggctaacattccaaactgggatgcggaataaacgtccgataataggttaaggaaggaaaattgaagtaggaatataccctttagctgaattgaaacatgaaagaaatatgaagttgtaatagtgtgataaagcatttaacaaattttttttgaagaggaaaagagttgaatatcaatacggtttgtgaaatagagatgacaaaaactctttgctacatgaattaagtttgaacgtt

SEQ ID NO: 496 - protein, 368 aa, Gossypium hirsutum
  misc_feature: Ceres CLONE ID no.1928532
  misc_feature: Bit score of 946.6 for HMM based on sequences of FIGURE 2.
  misc_feature: Functional Homolog Of Ceres SEEDLINE ID no. ME00045 at SEQ ID NO. 489
MISRKNMGSASPLLLITLVLGVCFATYNLVTMVMHNRSISKLTIYNSDGGIFVDPIIEMPESVRKLKRAKMPFHVALTATDAPYSKWQCRIMYYWYKKQKDLPGSEMGGFTRILHSGNPDNLMNEIPTVIVDPLPAGLDRGYIVLNRPWAFVQWLEKATIEEEYVLMAEPDHIFVTPLPNLAHGGYPAAFPFFYIKPDQNEKLLRKFFPEEMGPVTNIDPIGNSPVIIKKELLEKIAPTWMNVSLKMKDDPETDKTFGWVLEMYAYAVASALHGVQHVLQKDFMLQQPWDLEVGKKYIIHYTYGCDYNMKGELTYGKIGEWRFDKRSFLRGPPPRNLPLPPPGVPESVVTLVKMVNEATANIPNWDAE

SEQ ID NO: 497 - DNA, 1089 bp, Populus balsamifera subsp. trichocarpa
  misc_feature: Ceres ANNOT ID no.1490637
  misc_feature: Encodes the peptide sequence at SEQ ID NO 498
atgggacgggcttcgctgttagttctgattctattgactattggctttttctttgccacatataatttggttgccatgataatgcattatagatctattgggaaatgggcacatgacgattcggatggtcagatatttttggatccagttactgaaatgcctgaagacgtgaagaaagcaaagaatgccaaaatgcccttccatgttgctctaacagcaactgatgctccttacagcaaatggcagtgtcgcattatgtactactggtataagaagaagaaagacctgcccgggtcggagatgggaggctttacacggattttacactctggaaaacctgacaacttgatggatgagatccccacaactgtggttgatcctctgccagctggtcttgatcagggttacgttgtcctaaatagaccctgggcctttgtgcagtggctggaaaaggcttctatcgaggaagaatatattttaatggcagagcctgatcacgtatttataaatccccttccaaatttggcacgcggagggttgccagctgcttttccttttttctatatcaaacctgctgatcacgaaagcatcatacggaagtattatccggaggagaagggtcctgtgacaaacgttgatccaattggcaactctcctgtaattatcaagaaggaattgctggaaaagattgctcctacgtggatgaatatctccttgaaaatgaaaagagaccaggagactgataaagcttttggatgggtactagaaatgtatgcatatgctgtggcatcagctttacatgatgtgcagcacattcttcggaaagactttatggtgcagcctccatgggatttggcaacagggaagaattttatcattcattatacttatggatgtgactacaatttgaagggtgagctaacatatggaaaaattggagagtggcggtttgacaaaagatcatatctaggtggacctatgccaagaaatctcgccttgccccctcgaggggttccggaaagtgtggttacccttgtaaagatggtcaatgaagctactgcaaacattccaaattgggacacagaatag

SEQ ID NO: 498 - protein, 362 aa, Populus balsamifera subsp. trichocarpa
  misc_feature: Ceres ANNOT ID no.1490637
  misc_feature: Bit score of 944.0 for HMM based on sequences of FIGURE 2.
  misc_feature: Functional Homolog Of Ceres SEEDLINE ID no. ME00045 at SEQ ID NO. 489
MGRASLLVLILLTIGFFFATYNLVAMIMHYRSIGKWAHDDSDGQIFLDPVTEMPEDVKKAKNAKMPFHVALTATDAPYSKWQCRIMYYWYKKKKDLPGSEMGGFTRILHSGKPDNLMDEIPTTVVDPLPAGLDQGYVVLNRPWAFVQWLEKASIEEEYILMAEPDHVFINPLPNLARGGLPAAFPFFYIKPADHESIIRKYYPEEKGPVTNVDPIGNSPVIIKKELLEKIAPTWMNISLKMKRDQETDKAFGWVLEMYAYAVASALHDVQHILRKDFMVQPPWDLATGKNFIIHYTYGCDYNLKGELTYGKIGEWRFDKRSYLGGPMPRNLALPPRGVPESVVTLVKMVNEATANIPNWDTE

SEQ ID NO: 499 - DNA, 1083 bp, Populus balsamifera subsp. trichocarpa
  misc_feature: Ceres ANNOT ID no.1461381
  misc_feature: Encodes the peptide sequence at SEQ ID NO 500
atggggcgagcgtcgccattgctattggtgcttttggcactagggtttttctttgccacgtataacttgttgactttgataatacagtataaggattctagtacaggacttggatcagggatttctgatcctgttacagggatgccagccaattcttggaaattagggaagtcaaatttgaaattccatgttgctcttacggctactgatgctccttatagtcaatggcaatgccgggttatgtattattggtataagaaaatgaaaagcatgccaggatcagacatgggaaagttcactcgagttttgcattcggggaaaggtgatcatttgatggatgagattccaacttttattgttgatcctcttccagacggcctagatcggggatatattgtcttgaatagaccatgggcttttgtgcaatggctggaaaaggcaacaattgaggaagactacattctaatggcagagcctgaccacatattcgcaaatcctttgcctaacttggcacatggagataatccagcagggtttccatttttctatattaaaccaactgaacatgagaaaattgttagaaagttttatcctgaggagaagggtcctgtgacagatgttgatccaattggcaattcccctgtaataataaaaaagtccctgctggaggaaatttcgccaacatgggtgaatgtttcgttaagaatgaaagatgacccggagactgataaggcatttggttgggtgctagagatgtatgcctatgctgtagcatcagcattgcatggtgtacggcatatacttcgtaaagactttatgctacagcctccatgggatttggaagttggtaagagatttatcatccactatacttatggatgcgactataatatgaagggagaattaacatatggaaagattggagaatggcggtttgacaagagatcctatctcagtggtcctccaccaaagaacctcaccctgcccccaccaggagttcctgaaagcgtggtgagacttgtaaagatggtgaatgaggctacagctaacattccaggctgggactcattgaacagtggctga

SEQ ID NO: 500 - protein, 360 aa, Populus balsamifera subsp. trichocarpa
  misc_feature: Ceres ANNOT ID no.1461381
  misc_feature: Bit score of 874.5 for HMM based on sequences of FIGURE 2.
  misc_feature: Functional Homolog Of Ceres SEEDLINE ID no. ME00045 at SEQ ID NO. 489
MGRASPLLLVLLALGFFFATYNLLTLIIQYKDSSTGLGSGISDPVTGMPANSWKLGKSNLKFHVALTATDAPYSQWQCRVMYYWYKKMKSMPGSDMGKFTRVLHSGKGDHLMDEIPTFIVDPLPDGLDRGYIVLNRPWAFVQWLEKATIEEDYILMAEPDHIFANPLPNLAHGDNPAGFPFFYIKPTEHEKIVRKFYPEEKGPVTDVDPIGNSPVIIKKSLLEEISPTWVNVSLRMKDDPETDKAFGWVLEMYAYAVASALHGVRHILRKDFMLQPPWDLEVGKRFIIHYTYGCDYNMKGELTYGKIGEWRFDKRSYLSGPPPKNLTLPPPGVPESVVRLVKMVNEATANIPGWDSLNSG

SEQ ID NO: 501 - DNA, 1083 bp, Populus balsamifera subsp. trichocarpa
  misc_feature: Ceres ANNOT ID no.1440313
  misc_feature: Encodes the peptide sequence at SEQ ID NO 502
atggggcgagcgtcgccattgcttttggtgcttttggcactaggatttttctttgcgatgtataacttgttgactttggtaatacaatataaggattctagttcaggagctggatcagggaatcctgatcctgtaatacggatgccaaccaatttgaggaaattagggaagtcgaatttgaaattccatgttgcccttacggctactgatgctccttatagtcaatggcaatgccggattatgtattattggtataagaagatgaaaaacatgccaggatcagacatgggaaagtttactcgagtgttgcattcgggaaaaggtgatcatttgatggacgagattccaacttttgttgttgatcctcttccggagggcttagatcggggctatattgtcttaaatagaccgtgggcttttgtgcaatggctggaaaaagcaactattgaggaagaatacattctaatggcagaacctgaccacatatttgcaaatcctttgcctaacttggcacatggagataatccagcagggtttccatttttctatattaaaccaactgaacacgagaaaattgttcgaaagttttatcccgaggagaagggtcctgtgaccgacgttgatccaattggcaattctcccgtaataataaaaaagtcactgctggaggaaatttcaccaacatgggtgaatgtttcgctaagaatgaaagatgacccagagactgataaggcatttggttgggtgcttgaaatgtatgcctatgctgtagcatcagcattgcatggtgtgcggcatatactccatgaagactttatgctacagccaccatgggatttggaagttgggaagagatttattatccactacacttatggatgcgactacaatatgaagggagaattaacatatggaaagattggagaatggcggtttgacaagagatcctatctcagtggtcctccaccaaagaacatttccctgcccccaccaggagttcctgaaagtgtggtgagacttgtaacgatggttaatgaggctacagctaacatccctggctgggactcattaaacagtggctga

SEQ ID NO: 502 - protein, 360 aa, Populus balsamifera subsp. trichocarpa
  misc_feature: Ceres ANNOT ID no.1440313
  misc_feature: Bit score of 865.7 for HMM based on sequences of FIGURE 2.
  misc_feature: Functional Homolog Of Ceres SEEDLINE ID no. ME00045 at SEQ ID NO. 489
MGRASPLLLVLLALGFFFAMYNLLTLVIQYKDSSSGAGSGNPDPVIRMPTNLRKLGKSNLKFHVALTATDAPYSQWQCRIMYYWYKKMKNMPGSDMGKFTRVLHSGKGDHLMDEIPTFVVDPLPEGLDRGYIVLNRPWAFVQWLEKATIEEEYILMAEPDHIFANPLPNLAHGDNPAGFPFFYIKPTEHEKIVRKFYPEEKGPVTDVDPIGNSPVIIKKSLLEEISPTWVNVSLRMKDDPETDKAFGWVLEMYAYAVASALHGVRHILHEDFMLQPPWDLEVGKRFIIHYTYGCDYNMKGELTYGKIGEWRFDKRSYLSGPPPKNISLPPPGVPESVVRLVTMVNEATANIPGWDSLNSG

SEQ ID NO: 503 - DNA, 1176 bp, Populus balsamifera subsp. trichocarpa
  misc_feature: Ceres ANNOT ID no.1448275
  misc_feature: Encodes the peptide sequence at SEQ ID NO 504
atgggacaggcttcgtcaccagttctgattctattagcttttgggtttttctttgctacatacaacttagtcaccatgacaatgcacaatagatctattgggaaatgggtatatgacgattcggatggtgaggcatttttcgatccagttattgaaatgcctgaagaggtgaagaaaccaaagaatgccaggatgcccttccatgttgccttaacagcaactgatgctccctacagcaaatggcagtgtcgcattatgtactactggtataagaagaacagagacctgtctgggtcggagatgggaggatttacacggattttgcactctggaaagcctgacaacttgatggatgagatgcctacagttgtggttgatcctcttcctgcaggtctcgatcggggttacatcgtcctaaatagaccatgggcctttgtgcagtggctggaaaagactaccattgaggaagaatatatattaatggcagagcctgatcatatacttgtgaatccccttccaaatctagcacgtggagggttgccggctgcttttccatttttctatatcgaacctgctaaattcgaaaatatcgtaaggaagtattatccagaggagaagggtcctgtgacagatatcgatccaattggcaactctcctgtaattatcaagaagtttttctgttggatgaaagatgagttattatctgaaccttatgattttcaggaacttctggaaaagatagctcctaaatggatgaacgtttccttgaaaatgaaaaatgacaaggagactgataaagcttttggatgggtactagaaatgtttttgacactcctgtttttggtcgctgaactaaggtatgcatatgctgtggcagcagctttgaacgacgtgcagcatgttcttcggaaagattttatgctgcagcccccatgggatctgagcactaggaaattttttatcattcattatacttatggatgtgactacaacttaaagggtcagctaacatatggaaaaattggagagtggagatttgacaagagatcatatctacgagggcctccaccaaaaaacctccccttgccccctccaggggttccagaaagtgtggttaccctcgtaaagatggtcaatgaagctactgctaacattcctaattgggatgcagagtag

SEQ ID NO: 504 - protein, 391 aa, Populus balsamifera subsp. trichocarpa
  misc_feature: Ceres ANNOT ID no.1448275
  misc_feature: Bit score of 854.3 for HMM based on sequences of FIGURE 2.
  misc_feature: Functional Homolog Of Ceres SEEDLINE ID no. ME00045 at SEQ ID NO. 489
MGQASSPVLILLAFGFFFATYNLVTMTMHNRSIGKWVYDDSDGEAFFDPVIEMPEEVKKPKNARMPFHVALTATDAPYSKWQCRIMYYWYKKNRDLSGSEMGGFTRILHSGKPDNLMDEMPTVVVDPLPAGLDRGYIVLNRPWAFVQWLEKTTIEEEYILMAEPDHILVNPLPNLARGGLPAAFPFFYIEPAKFENIVRKYYPEEKGPVTDIDPIGNSPVIIKKFFCWMKDELLSEPYDFQELLEKIAPKWMNVSLKMKNDKETDKAFGWVLEMFLTLLFLVAELRYAYAVAAALNDVQHVLRKDFMLQPPWDLSTRKFFIIHYTYGCDYNLKGQLTYGKIGEWRFDKRSYLRGPPPKNLPLPPPGVPESVVTLVKMVNEATANIPNWDAE

SEQ ID NO: 505 - DNA, 1200 bp, Populus balsamifera subsp. trichocarpa
  misc_feature: Ceres ANNOT ID no.1437838
  misc_feature: Encodes the peptide sequence at SEQ ID NO 506
atgggacgggcttcgctgttagttctgattctattgactattggctttttctttgccacatataatttggttgccatgataatgcattatagatctattgggaaatgggcacatgacgattcggatggtcagatatttttggatccagttactgaaatgcctgaagacgtgaagaaagcaaagaatgccaaaatgcccttccatgttgctctaacagcaactgatgctccttacagcaaatggcagtgtcgcattatgtactactggtataagaagaagaaagacctgcccgggtcggagatgggaggctttacacggattttacactctggaaaacctgacaacttgatggatgagatccccacaactgtggttgatcctctgccagctggtcttgatcagggttacgttgtcctaaatagaccctgggcctttgtgcagtggctggaaaaggcttctatcgaggaagaatatattttaatggcagagcctgatcacgtatttataaatccccttccaaatttggcacgcggagggttgccagctgcttttccttttttctatatcaaacctgctgatcacgaaagcatcatacggaagtattatccggaggagaagggtcctgtgacaaacgttgatccaattggcaactctcctgtaattatcaagaagtggtatattctctgttggatgaaaaatgagagattatcagaactttatgatcttcaggaattgctggaaaagattgctcctacgtggatgaatatctccttgaaaatgaaaagagaccaggagactgataaagcttttggatgggtactagaaatgtatgcatatgctgtggcatcagctttacatgatgtgcagcacattcttcggaaagactttatggtgcagcctccatgggatttggcaacagggaagaattttatcattcattatacttatggatgtgactacaatttgaagggtgagctaacatatggaaaaattggagagtggcggtttgacaaaagatcatatctaggtggacctatgccaagaaatctcgccttgccccctcgaggggttccggaaagtgtgctggttctgacgggtctgagtcatattcttgttgcagcaaatagaagcatgaatgttacccttgtaaagatggtcaatgaagctactgcaaacattccaaattgggacacagaatag

SEQ ID NO: 506 - protein, 399 aa, Populus balsamifera subsp. trichocarpa
  misc_feature: Ceres ANNOT ID no.1437838
  misc_feature: Bit score of 887.7 for HMM based on sequences of FIGURE 2.
  misc_feature: Functional Homolog Of Ceres SEEDLINE ID no. ME00045 at SEQ ID NO. 489
MGRASLLVLILLTIGFFFATYNLVAMIMHYRSIGKWAHDDSDGQIFLDPVTEMPEDVKKAKNAKMPFHVALTATDAPYSKWQCRIMYYWYKKKKDLPGSEMGGFTRILHSGKPDNLMDEIPTTVVDPLPAGLDQGYVVLNRPWAFVQWLEKASIEEEYILMAEPDHVFINPLPNLARGGLPAAFPFFYIKPADHESIIRKYYPEEKGPVTNVDPIGNSPVIIKKWYILCWMKNERLSELYDLQELLEKIAPTWMNISLKMKRDQETDKAFGWVLEMYAYAVASALHDVQHILRKDFMVQPPWDLATGKNFIIHYTYGCDYNLKGELTYGKIGEWRFDKRSYLGGPMPRNLALPPRGVPESVLVLTGLSHILVAANRSMNVTLVKMVNEATANIPNWDTE

SEQ ID NO: 507 - DNA, 1038 bp, Populus balsamifera subsp. trichocarpa
  misc_feature: Ceres ANNOT ID no.1501275
  misc_feature: Encodes the peptide sequence at SEQ ID NO 508
atgggacaggcttcgtcaccagttctgattctattagcttttgggtttttctttgctacatacaacttagtcaccatgacaatgcacaatagatctattgggaaatgggtatatgacgattcggatggtgaggcatttttcgatccagttattgaaatgcctgaagaggtgaagaaaccaaagaatgccaggatgcccttccatgttgccttaacagcaactgatgctccctacagcaaatggcagtgtcgcattatgtactactggtataagaagaacagagacctgtctgggtcggagatgggaggatttacacggattttgcactctggaaagcctgacaacttgatggatgagatgcctacagttgtggttgatcctcttcctgcaggtctcgatcggggttacatcgtcctaaatagaccatgggcctttgtgcagtggctggaaaagactaccattgaggaagaatatatattaatggcagagcctgatcatatacttgtgaatccccttccaaatctagcacgtggagggttgccggctgcttttccatttttctatatcgaacctgctaaattcgaaaatatcgtaaggaagtattatccagaggagaagggtcctgtgacagatatcgatccaattggcaactctcctgtaattatcaagaaggaacttctggaaaagatagctcctaaatggatgaacgtttccttgaaaatgaaaaatgacaaggagactgataaagcttttggatggcatgttcttcggaaagattttatgctgcagcccccatgggatctgagcactaggaaattttttatcattcattatacttatggatgtgactacaacttaaagggtcagctaacatatggaaaaattggagagtggagatttgacaagagatcatatctacgagggcctccaccaaaaaacctccccttgccccctccaggggttccagaaagtgtggttaccctcgtaaagatggtcaatgaagctactgctaacattcctaattgggatgcagagtag

SEQ ID NO: 508 - protein, 345 aa, Populus balsamifera subsp. trichocarpa
  misc_feature: Ceres ANNOT ID no.1501275
  misc_feature: Bit score of 830.6 for HMM based on sequences of FIGURE 2.
  misc_feature: Functional Homolog Of Ceres SEEDLINE ID no. ME00045 at SEQ ID NO. 489
MGQASSPVLILLAFGFFFATYNLVTMTMHNRSIGKWVYDDSDGEAFFDPVIEMPEEVKKPKNARMPFHVALTATDAPYSKWQCRIMYYWYKKNRDLSGSEMGGFTRILHSGKPDNLMDEMPTVVVDPLPAGLDRGYIVLNRPWAFVQWLEKTTIEEEYILMAEPDHILVNPLPNLARGGLPAAFPFFYIEPAKFENIVRKYYPEEKGPVTDIDPIGNSPVIIKKELLEKIAPKWMNVSLKMKNDKETDKAFGWHVLRKDFMLQPPWDLSTRKFFIIHYTYGCDYNLKGQLTYGKIGEWRFDKRSYLRGPPPKNLPLPPPGVPESVVTLVKMVNEATANIPNWDAE

SEQ ID NO: 509 - DNA, 1669 bp, Glycine max
  misc_feature: Ceres CLONE ID no.1644562
  misc_feature: Encodes the peptide sequence at SEQ ID NO 510
gctgcttcaaacctccgcgttttctagtgccttgttgctacttacaccctattgttgaaaagtcaatcccccacaaatccctttttccacatccaccccttctccatttccttccttcaaaacattgcttacccttctcttttttcccccaaagtttcgttcttttgtatcttctctcattcaaagtttgagtcttccgcatttggggtgccctgaattgccgtgcaagttcagatctgcttacagaattcatatttgaatcggtgaagattttgaaaatgatcgtgagaaaaggcatggggcgagcaaagtcactgcttttgctgcttatggtgcttttgttttcctttgccacttataatttggtagctatgatcatggaccataaggcagatgggttggagtctttgaatagaaaaatgatggtatcgggaaagactaattcaaagtttcatgttgccgtgaccgcaaccgatgccgcttacaatcaatggcaatgccggattatgtactattggtataagaaagtgaaggacatgcctggatcagatatggggaaattcacccgtattttgcattctggaaggtcagaccagctgatggatgagattcctacttttgtggttgatccacttcctgagggcttggataagggttatattgtcctaaatagaccatgggcttttgttcagtggctggagaaagcagatattgaggaagaatatattctgatggcagaacctgaccacatatttgtaaagcctttgcctaatttggctcagggaaccctgcccgcagcatttccatttttctatataaaaccagatcagaatgaaaaaataatcaggaaattctatcctgaggaaaacggtcctgttactgatgttgatccaattggcaattctcctgtaatcattaagaagtctttgatggaggaaatagcttccacatgggtaaatgtttcattgagaatgaaagatgatcaagagactgataaagcttttggatgggtgcttgaaatgtatgcttatgctgtggcatctgcattgcatggtgtaaagcataatcttcgcaaagactttatgcttcagccaccttgggacttaaatgttgagaataagtttatcatccactatacatatggatgtgactataatatgaagggggaactgacatatgggaagattggagaatggcgttttgacaagaggtcttatcttttgggtcctccacccaaaaacctgcccttaccgcctccaggagttcctgaaagtgtggtgcggcttgttaaaatggtcaatgaggctactgcaaacatacctgaatgggattcattaaacaaaagctgagggaatgatgataaaccataaagccagtgattttgagatgaggactacaaataccatatcaaaaatagattagtttaagcaaataggagttgtgataaatacaaatgatgcttgtgctttctatgaaaatagatttttttttcttttaatggccaggaaattcttttacattcaaacgtatacaagacctttacaatctattacactgttgtagttttgcaaactgattgttatcatattgcaaccaatggaatggcatcttatcccttttgttttcccccacctttggtggatgaaactaaaaaaaaaaaaaaaaaaaa

SEQ ID NO: 510 - protein, 350 aa, Glycine max
  misc_feature: Ceres CLONE ID no.1644562
  misc_feature: Bit score of 820.2 for HMM based on sequences of FIGURE 2.
  misc_feature: Functional Homolog Of Ceres SEEDLINE ID no. ME00045 at SEQ ID NO. 489
MGRAKSLLLLLMVLLFSFATYNLVAMIMDHKADGLESLNRKMMVSGKTNSKFHVAVTATDAAYNQWQCRIMYYWYKKVKDMPGSDMGKFTRILHSGRSDQLMDEIPTFVVDPLPEGLDKGYIVLNRPWAFVQWLEKADIEEEYILMAEPDHIFVKPLPNLAQGTLPAAFPFFYIKPDQNEKIIRKFYPEENGPVTDVDPIGNSPVIIKKSLMEEIASTWVNVSLRMKDDQETDKAFGWVLEMYAYAVASALHGVKHNLRKDFMLQPPWDLNVENKFIIHYTYGCDYNMKGELTYGKIGEWRFDKRSYLLGPPPKNLPLPPPGVPESVVRLVKMVNEATANIPEWDSLNKS

SEQ ID NO: 511 - DNA, 2041 bp, Gossypium hirsutum
  misc_feature: Ceres CLONE ID no.1925967
  misc_feature: Encodes the peptide sequence at SEQ ID NO 512
gagcttagcggagaacaaaaacttgtcgcacatatggaaaaaaacagtggaaaccaaaccaaatactgacaactgacaagccaaaagcaaagatcttaccatcttaaaacataaaccacatcagttgtccaccaagtaggcccccattttttaattatactattgcttagaagcaatccaccctttccatcttgccaagacttccgcgttttccaccattgccgttgaatagaagaaactaaaccccaaatctctcccatgccttcagattctttctttggatttctgagggatttatgatcaattgtctgggatttttcagtaaagggtattcttacttgctgcaattctgtactgtcagcttccaattttcacggtttggtagattattgtgaattttttctccagatgttgttcgaaaagcataaattgaattaggcgttgcggctgtgagaagggctgggttttgtattgtgtagtgaaagatgaagcgcgtttcgccgctctttttggtacttttagtccttggattcttctttgcaacatataatttgttgactatgataatacactataagacatatacttcagagcaatgggatttctccaatccttttatacaaatgccttggaatttgatggaaggtgagggttctaactcaaagtaccacgttgctctcacggcaacagatgctccgtatagccaatggcagtgtcggattatgtattattggtataagaaggtaaaagagatgcctggatcagatatgggaaagttcactcgaattttgcattcagggaagcccgacaatttgatggaggagattccaacttttgtcgttgaccctcttccagagggtttagatcggggttatattgtcttaaatagaccatgggcttttgtgcaatggctggaaaaagcaatgattgacgaagaatacattctaatggccgaacctgaccatgtatttgtaaatcctttgcctaacttggctcgtggaaaacatccagcagggtttcctttcttttacattaagccatctgaccacaagcatgttattaggaagtattatcctgaggagaagggtcctgtgacgaatattgatccaattggcaattctccagtgattattaaaaagtctgtgctggagaaaattgcacctacatggatgaatatttctttgaggatgaaagatgacccagtgactgacaaggaatttggatgggtgctagaaatgtatgcgtatgctgtggcatctgcactgcatgacgtgcaccacatacttcataaagacttcatgctccagccaccatgggatacggaagtagggaagaagtttataatccattatacttacggatgtgactacaatttgaagggagaattaacatatggaaagattggagaatggcgtttcgataagagatcgtaccttagtgggcctcctccaaggaacctctctttgccccctccaggtgttcctgaaagtgtgttatcaactcaatgttgttgctgattggtgacataaagttggtgatattcgatgctggaagtactactgagtagcggcttggcactaatattctgctattgcctcaaaccataatagaaaaatcagtcaatcatcctatccagactgtttccccgagtcttgatgcctatttaaataaactcggcaaattaaatagtttctcaacataaacttttctagttgcaaacagtttctaatgtgatctttgcaatatctgcaggtgaaacttgtgaagatggtgaacgaagctacagaggatattcccaattgggatacactaaatcgtggctgagatctaatcttactaatctgcgcatccattttgacgctgttatcaatctgctttccaactagagttatggacatgaattacaaaggtagctgagacagcagtatacatagagaaaagggtatgtttacaagttaaaggagggatatatcatttttttacacttatatttataatcatgaaatgccttcttttgtgttaaaaaaaaaaaaaaaaaaaa

SEQ ID NO: 512 - protein, 343 aa, Gossypium hirsutum
  misc_feature: Ceres CLONE ID no.1925967
  misc_feature: Bit score of 776.1 for HMM based on sequences of FIGURE 2.
  misc_feature: Functional Homolog Of Ceres SEEDLINE ID no. ME00045 at SEQ ID NO. 489
MKRVSPLFLVLLVLGFFFATYNLLTMIIHYKTYTSEQWDFSNPFIQMPWNLMEGEGSNSKYHVALTATDAPYSQWQCRIMYYWYKKVKEMPGSDMGKFTRILHSGKPDNLMEEIPTFVVDPLPEGLDRGYIVLNRPWAFVQWLEKAMIDEEYILMAEPDHVFVNPLPNLARGKHPAGFPFFYIKPSDHKHVIRKYYPEEKGPVTNIDPIGNSPVIIKKSVLEKIAPTWMNISLRMKDDPVTDKEFGWVLEMYAYAVASALHDVHHILHKDFMLQPPWDTEVGKKFIIHYTYGCDYNLKGELTYGKIGEWRFDKRSYLSGPPPRNLSLPPPGVPESVLSTQCCC

SEQ ID NO: 513 - DNA, 1389 bp, Zea mays
  misc_feature: Ceres CLONE ID no.295496
  misc_feature: Encodes the peptide sequence at SEQ ID NO 514
agaatctctctttaagagggatacagagtaggaaagagacagagggggcaaagagcgatggacgccgcggtgcggaaggccgcgggcgccggcatcgcgcgcgcgccggcgctggtgctagcgctggtggcggcgggggcgttcctgatctcctacaacttcttcaccatgctgttccacggcggcggcggaataggcgcggcggcgaccgctgggacgagggaccctgtggtggccatgccagcgtggatgcgcgcggcggcggacaccgaggcgcggcggcggccgttccatgtggcgctcacggccacggacgcgccctacagccggtggcagtgccgggtcatgtacttctggtacaagcggatgcaggcgcggccgggcggagaggccatgggcgggttcacgcgcgtgctgcactcggggaagcccgacgggctcatggacgagatccccaccttcgtcgtcgacccgctgcccgctggcaaggaccacggatatgtggtcctaaataggccgtgggcatttgtgcagtggcttcagaaagcaaagattgaagaagagtatatactaatggcagaaccagaccatatatttgtgaaacctctaccaaatttggcccatgacgatgatccggcagcatttcccttcttttacattacaccatcagaacatgaaaaaattatcaggaaatactatgctaaagaaagaggtcctgtcacagatatcgatccgattgggaattctcctgtgataattaagaagacaattcttgagaagattgcccccacatggatgaatgtgtcaattcaaatgaaagaggatgaagaaacagataaagtttttggatgggtgttggaaatgtatgcatacgctgttgctagcgcattgcatggagttcatcatatccttcgtaaagatttcatgatccagccaccttttgatacaaagctccagaatacatttataatccacttcacttatggatgtgactactcactaaagggtgaactgacctatggtaaagttggtgaatggcgatttgacaaaagatcattcccagataggccaccaccaagaaatcttacattgccccctcctggagtaccagaaagtgtggttactctagtgaaaatggtcaatgaagctagtgcaaaccttcctcggtgggatgatggaatataaactttggatgatatcaattatatcttaggttcctttgatctgcccttgtatatggggaatatcaaagtatcaggtgcagtcggttgtttggtttacatccaaaatagctgcttgcacttgcacaccatacctgatagaagaagatacataattttctcagtgtactttttatgaaaagaaaagaaatgaaagtaaaagttagct

SEQ ID NO: 514 - protein, 375 aa, Zea mays
  misc_feature: Ceres CLONE ID no.295496
  misc_feature: Bit score of 911.5 for HMM based on sequences of FIGURE 2.
  misc_feature: Functional Homolog Of Ceres SEEDLINE ID no. ME00045 at SEQ ID NO. 489
MDAAVRKAAGAGIARAPALVLALVAAGAFLISYNFFTMLFHGGGGIGAAATAGTRDPVVAMPAWMRAAADTEARRRPFHVALTATDAPYSRWQCRVMYFWYKRMQARPGGEAMGGFTRVLHSGKPDGLMDEIPTFVVDPLPAGKDHGYVVLNRPWAFVQWLQKAKIEEEYILMAEPDHIFVKPLPNLAHDDDPAAFPFFYITPSEHEKIIRKYYAKERGPVTDIDPIGNSPVIIKKTILEKIAPTWMNVSIQMKEDEETDKVFGWVLEMYAYAVASALHGVHHILRKDFMIQPPFDTKLQNTFIIHFTYGCDYSLKGELTYGKVGEWRFDKRSFPDRPPPRNLTLPPPGVPESVVTLVKMVNEASANLPRWDDGI

SEQ ID NO: 515 - protein, 360 aa, Oryza sativa subsp. japonica
  misc_feature: Public GI ID no.115463637
  misc_feature: Bit score of 889.7 for HMM based on sequences of FIGURE 2.
  misc_feature: Functional Homolog Of Ceres SEEDLINE ID no. ME00045 at SEQ ID NO. 489
MSGRKNAGKASPFLLLLISVGCFFATYNFLTMVGHGRSRDAGPRKILGGVGGVGGGGSDPSKRFHVALTATDALYSQWQSRVMYYWYREMRDRPGSDMGGFTRILHSGKPDGLMDEIPTLVVDPLPEGADRGYIVLNRPWAFVQWLKKSNIKEDYVLMAEPDHIFVRPLPNLAHGDEPAAFPFFYIKPTENEIILRKFFPEENGPVSKIDPIGNSPVIIKKAQLEKIAPTWMNISLKMKEDVETDKAFGWVLEMYAYAVASALHGVHYSLRKDFMIQPPWDAKSDNTFIIHYTYGCDYTLKGELTYGKIGEWRFDKRSYLRSPPPRNLTLPPPGVPESVATLVKMVNEATANIPGWDEER

SEQ ID NO: 516 - protein, 372 aa, Oryza sativa subsp. japonica
  misc_feature: Public GI ID no.115435904
  misc_feature: Bit score of 859.1 for HMM based on sequences of FIGURE 2.
  misc_feature: Functional Homolog Of Ceres SEEDLINE ID no. ME00045 at SEQ ID NO. 489
MNAAARKAAAAARLPAAVLVVVAVGAFLISYNLLAIVLRGGGGAATGAGRERDPVVAMPGWMRAAGSAGGGRRRPFHVALTATDAAYSRWQCRVMYYWYKRMQARPEGADMGGFTRVLHSGKPDALMGEIPTFVVDPLPAGKDHGYVVLNRPWAFVQWLEKAKIEEEYILMAEPDHIFVRPLPNLARDDPAAFPFFYITPSEHESVLRKYYPKERGPVTNIDPIGNSPVIIKKIQLEKIAPTWMNVSIQMKEDQETDKAFGWVLEMYAYAVASALHGVQHILRKDFMIQPPFDTKLGNTFIIHFTYGCDYTLKGVLTYGKIGEWRFDKRAYQDRPPPRNLTLPPPGVPESVVTLVKMVNEATANLPGWDDGR

SEQ ID NO: 517 - DNA, 1853 bp, Panicum virgatum
  misc_feature: Ceres CLONE ID no.1999444
  misc_feature: Encodes the peptide sequence at SEQ ID NO 518
ggctgggattttgccttgttccccatgacggcgtcagcttaagcccttcctctcgctgctccctctccttccctgcatcgccgcggcggaggcccgcgagaccggccggcgatcgccgggcttgtcgcggtgggtgccctcgcctcgccctccccttcgccgccccctatcccctcccggcaatactctctcgcccgatcccttagcttcacccgcccgagggcgatcccaatcatcccagatccggcccgcgactcgccctgctctaccccactcccacggcagaggctcccaggtggctcccgcgatcggcccgcccgccagcgccgcctcgcgcggctcgacaggagtagcggcgcccccctccccctggttgcgggttgggggctcggctgtcgaggatgagcgggaggaagaatgccggcaggacctccccctggctgctcatcctcatctccgctgggtgcttcttcgcgacctacaacttcctgacgatgcacggccggggccgggacgggccgcgcaagctcctcgacggcgggggctcctacgggtcgcgctccggctccgacccggcgaagcggttccacgtcgcgctgacggcgacggacgcgctctacagccagtggcagtcccggatcatgcactactggtacaaggagatgagggaccgccccggctccgacatgggcggcttcacgcggatccttcactcggggaagcctgatgggttgatggatgagatacccaccatggtggtggaccctcttcctgaaggcaaggataagggatacattgtcttgaataggccgtgggcatttgtccagtggctgcagagagcaaaaattgacgaagactacatactaatggcggagccagatcatgtctttgtgaagcctttgccaaacttagctcatggtgatgaaccagcagcatttccatttttctacatcaatccaactgtgaatgagaagatattgcggaagttttttccagaggaaaaaggacctgtctcaaaaattgatcctatcggcaactctccagttataatcaagaaggcccaacttgagaagattgctccaacctggatgaatgtttcattaaaaatgaaagaggatcaggatacagacaaagcttttggatgggtcttggaaatgtatgcatatgctgttgctagtgcactgcatggtgtgcaccatagtctccgtaaagatttcatgattcagcctccttgggacctaaaaacagacaacacattcattatccattatacgtatggatgtgattatacaaatgagggtcagctaacttatgggaaaattggtgaatggcgttttgacaaaagatcttatcttgaatcaccaccaccaagaaatctttcactaccccctcctggagttcctgaaagtgtggtcactcttgtgaagatggtgaatgaggccactgcaaacattccagggtgggaggatgagagataatctgatggcctgatcagttgtagcttattttagctcctagctggtatggtttttgttggaaaacatagaggaataccacgggtgaataaaagaagagcgttcaattcatatctgaagtgtaggactgtggtcaattttctacagttcaacgtaggttagtgttcaggaagaaaaagatatattcactttgatctagtgagttgcatcattttttgtattgtaaagcagaaatatgggcttttggctacttttggttcatttagccgtgttgtaaatcagagatgtagtttagagtcctccaaccctgagaggtttgttattagtcatcttgggaaaagttctgctgggtgctgccaaaaaaaaaaaaaaaaaaaa

SEQ ID NO: 518 - protein, 358 aa, Panicum virgatum
  misc_feature: Ceres CLONE ID no.1999444
  misc_feature: Bit score of 896.6 for HMM based on sequences of FIGURE 2.
  misc_feature: Functional Homolog Of Ceres SEEDLINE ID no. ME00045 at SEQ ID NO. 489
MSGRKNAGRTSPWLLILISAGCFFATYNFLTMHGRGRDGPRKLLDGGGSYGSRSGSDPAKRFHVALTATDALYSQWQSRIMHYWYKEMRDRPGSDMGGFTRILHSGKPDGLMDEIPTMVVDPLPEGKDKGYIVLNRPWAFVQWLQRAKIDEDYILMAEPDHVFVKPLPNLAHGDEPAAFPFFYINPTVNEKILRKFFPEEKGPVSKIDPIGNSPVIIKKAQLEKIAPTWMNVSLKMKEDQDTDKAFGWVLEMYAYAVASALHGVHHSLRKDFMIQPPWDLKTDNTFIIHYTYGCDYTNEGQLTYGKIGEWRFDKRSYLESPPPRNLSLPPPGVPESVVTLVKMVNEATANIPGWEDER

SEQ ID NO: 519 - protein, 370 aa, Oryza sativa subsp. indica
  misc_feature: Public GI ID no.125552168
  misc_feature: Bit score of 868.2 for HMM based on sequences of FIGURE 2.
  misc_feature: Functional Homolog Of Ceres SEEDLINE ID no. ME00045 at SEQ ID NO. 489
MSGRKNAGKASPFLLLLISVGCFFATYNFLTMVGHGRSRDAGPRKILGGVGGVGGGGSDPSKRFHVALTATDALYSQWQSRVMYYWYREMRDRPGSDMGGFTRILHSGKPDGLMDEIPTLVVDPLPEGADRGYIVLNRPWAFVQWLKKSNIKEDICSYVLMAEPDHIFVRPLPNLAHGDEPAAFPFFYIKPTENEKILRKFFPEENGPVSKIDPIGNSPVIIKKAQLEKIAPTWMNISLKMKEDVETDKAFGWVLEMSVLLCVQYAYAVASALHGVHYSLRKDFMIQPPWDAKSDNTFIIHYTYGCDYTLKGELTYGKIGEWRFDKRSYLRSPPPRNLTLPPPGVPESVATLVKMVNEATANIPGWDEER

SEQ ID NO: 520 - protein, 370 aa, Oryza sativa subsp. japonica
  misc_feature: Public GI ID no.125594093
  misc_feature: Bit score of 866.2 for HMM based on sequences of FIGURE 2.
  misc_feature: Functional Homolog Of Ceres SEEDLINE ID no. ME00045 at SEQ ID NO. 489
MSGRKNAGKASPFLLLLISVGCFFATYNFLTMVGHGRSRDAGPRKILGGVGGVGGGGSDPSKRFHVALTATDALYSQWQSRVMYYWYREMRDRPGSDMGGFTRILHSGKPDGLMDEIPTLVVDPLPEGADRGYIVLNRPWAFVQWLKKSNIKEDICSYVLMAEPDHIFVRPLPNLAHGDEPAAFPFFYIKPTENEIILRKFFPEENGPVSKIDPIGNSPVIIKKAQLEKIAPTWMNISLKMKEDVETDKAFGWVLEMSVLLCVQYAYAVASALHGVHYSLRKDFMIQPPWDAKSDNTFIIHYTYGCDYTLKGELTYGKIGEWRFDKRSYLRSPPPRNLTLPPPGVPESVATLVKMVNEATANIPGWDEER

SEQ ID NO: 521 - DNA, 1452 bp, Zea mays
  misc_feature: Ceres CLONE ID no.221188
  misc_feature: Encodes the peptide sequence at SEQ ID NO 522
gttgtaggacgaaacgagttctttgtcctgggcctttgtcactcttctctgtgtaacgacttcctccctttcctgccgcaccacgcaatcaccggggcggaggcggctgccggcgagcacttgggcgtctccggccaccgcctgcctcgttgtggctccccgttgactcccgcgatttgttacccgctggcgctgccgcacacagctcaaaaggagtagcagcgcccctggttgccggttggagcgtcaaggatgagcgggaggaagaatgcgggcaaggtttccccctggttgctcgtcctcatctgtttagggtgcttctttgtgacctacaacctcctgacgatgcccagccggggacgggatgggccgcgcaagttcctcggcggcggcggggatcgccactcaactgcctcgttggggtcaggctctgattcggaccccgcgaagcggttccacgtcgcgcttacggcgacggacgcactgtacagtcagtggcagtcgcggataatgcactactggtataaggagatgagggaccgacctggttccgacatgggtggcttcactaggatccttcactcgggcaagcctgatggattgatggatgagatacccaccatggtggttgatccccttcctgaaggcaaggatcagggatatattgtcttaaataggccttgggcttttgtccagtggatccagaaagcaaagatcgtagaagagtatatattaatggcagagccagatcatgtctttgtgaagcctttgccaaacttatctcatggtgatgagccagcggcatttccatttttctacatcaaaccgactgagaatgagaagatattgaggaagtttttcccagaagaaaaagggcctatttcaaatattgatcctattggcaactctccggttataatcaagaaggctcagcttgagaagattgctccaacctggatgaatgtttcattaaaaatgaaagaggatcaggagacagacaaagcattcggatgggtcttggaaatgtacgcatacgctgttgctagtgcactgcacggtgtgcaccatagtctccataaagattttatgattcagcctccttgggacctgaaaacggacaacacattcatcatccattatacgtatggatgcgattattcaatgaagggtcagcttacttatgggaaaatcggtgaatggcgttttgacaaaagatcttaccttcaatctcstccaccaagaartctttcactgccccctccaggagttcctgaaagtgtggtcacccttgtgaagatggtcaatgaggccaccgcaaacattccsgsgtgggaggacsatagatgattgatggtctggctgagttgtagtttattccagcacccagctggtatggcttttgttcaaaaacatggaagaatatcattggtcaataaaagaaaagcattgatt

SEQ ID NO: 522 - protein, 364 aa, Zea mays
  misc_feature: Ceres CLONE ID no.221188
  misc_feature: Bit score of 866.5 for HMM based on sequences of FIGURE 2.
  misc_feature: Functional Homolog Of Ceres SEEDLINE ID no. ME00045 at SEQ ID NO. 489
  misc_feature (327)..(327): Xaa is any aa, unknown, or other
  misc_feature (331)..(331): Xaa is any aa, unknown, or other
  misc_feature (358)..(358): Xaa is any aa, unknown, or other
  misc_feature (359)..(359): Xaa is any aa, unknown, or other
  misc_feature (363)..(363): Xaa is any aa, unknown, or other
MSGRKNAGKVSPWLLVLICLGCFFVTYNLLTMPSRGRDGPRKFLGGGGDRHSTASLGSGSDSDPAKRFHVALTATDALYSQWQSRIMHYWYKEMRDRPGSDMGGFTRILHSGKPDGLMDEIPTMVVDPLPEGKDQGYIVLNRPWAFVQWIQKAKIVEEYILMAEPDHVFVKPLPNLSHGDEPAAFPFFYIKPTENEKILRKFFPEEKGPISNIDPIGNSPVIIKKAQLEKIAPTWMNVSLKMKEDQETDKAFGWVLEMYAYAVASALHGVHHSLHKDFMIQPPWDLKTDNTFIIHYTYGCDYSMKGQLTYGKIGEWRFDKRSYLQSXPPRXLSLPPPGVPESVVTLVKMVNEATANIXXWEDXR

SEQ ID NO: 523 - DNA, 1089 bp, Populus balsamifera subsp. trichocarpa
  misc_feature: Ceres ANNOT ID no.1477714
  misc_feature: Encodes the peptide sequence at SEQ ID NO 524
atgggttgtgggaatttcttctttacagtactaataaccttgtcagtagcccttataacatacaacatccttatatcagcaaacgcaccacttaaacaagacttaccaggtccatcatcaagatcaacacttttggttgacccagtaatcaagatgccattagaaagatcaagaagatcaagttttggtaaaaagagactgtttcatacagctgtgacagcttctgattctgtgtataatacttggcagtgtagggtaatgtattattggtacaagaagcataaagatggacccaatagtgagatgggagggttcactaggatcttgcattctggaaagcctgataagtttatggaggaaatcccaacttttatagcacagcccttgcctgctgggatggatcagggctatatagttctcaacagaccttgggcatttgtgcaatggcttcaaaaaacagacataaaagaagattacatattgatggcagagccagatcatattattgttaagcccatcccgaacctatctaaagatggccttggagctgcgtttcctttcttttacattgaaccaaaaaagtatgagtctgtcctccgaaagtacttccctgaggataagggaccaataacaaacatcgaccccataggaaattctcctgtcattgttgggaaggaatctcttaagaagattgctcccacttggatgaatgtctccttggcaatgaaaaaggatcccgagacagataaagcttttggctgggtgcttgaaatgtatggttatgctgtttcatctgctctacatggcgttggcaacatcctgtacaaggacttcatgattcagcctccttgggatacagaagttggcaagaagttcataattcattacacttacggatgtgactatgatatgaagggtaaattaacctacggaaagattggagaatggaggtttgacaagagatcttatgataccgttatacccccaagaaaccttcccttgcctccaccgggtgttccagagagtgtggttactctggtgaaaatggtgaatgaagctactgcaaacattccaaattggggatcctaa

SEQ ID NO: 524 - protein, 362 aa, Populus balsamifera subsp. trichocarpa
  misc_feature: Ceres ANNOT ID no.1477714
  misc_feature: Bit score of 750.7 for HMM based on sequences of FIGURE 2.
  misc_feature: Functional Homolog Of Ceres SEEDLINE ID no. ME00045 at SEQ ID NO. 489
MGCGNFFFTVLITLSVALITYNILISANAPLKQDLPGPSSRSTLLVDPVIKMPLERSRRSSFGKKRLFHTAVTASDSVYNTWQCRVMYYWYKKHKDGPNSEMGGFTRILHSGKPDKFMEEIPTFIAQPLPAGMDQGYIVLNRPWAFVQWLQKTDIKEDYILMAEPDHIIVKPIPNLSKDGLGAAFPFFYIEPKKYESVLRKYFPEDKGPITNIDPIGNSPVIVGKESLKKIAPTWMNVSLAMKKDPETDKAFGWVLEMYGYAVSSALHGVGNILYKDFMIQPPWDTEVGKKFIIHYTYGCDYDMKGKLTYGKIGEWRFDKRSYDTVIPPRNLPLPPPGVPESVVTLVKMVNEATANIPNWGS

SEQ ID NO: 525 - DNA, 1816 bp, Panicum virgatum
  misc_feature: Ceres CLONE ID no.1787953
  misc_feature: Encodes the peptide sequence at SEQ ID NO 526
agcgattgccgcccacccacccacgcagtgccgaccttcttgttgcccccgccggggtccagcccgctggccggcggcgctcccgcgccgccttgccttcgctgtcggccgaaccgccaaaaccaccagatcctctgcaacgagttcctctccttcccacgccgtcaccgcggcggaggcgacagccgctgaccgctcagccctctccggccggccaccgcctgcctcgtcgtggcttcgaagtgactccggcgatcggtccctcgctggcgctgccgcgcacggctcgacaagagtaggcggcgccccctggttgcgggttggggcgtgaaggatgagcgggaggaagaatgccggaagcacctccccctggatgctcatcctcatctccctagtatgcttcttcgcgacctacaacttcctgacgatgcccagccggggttgggacgggccgcgcaagttcctcggcgggggcggcggggatcgggactcggctgtctcgtacaggtcgggctctggttcggaccccaataagcggttccacgtcgcgctgacggcgacggatgcgctttacagccagtggcagtcccggataatgcactattggtacaaggagatgagggaccggcctgggtccgatatgggcggcttcacaaggatccttcactcggggaagcctgatggattgatggatgagatacccaccatggtggttgacccgcttcctgaaggcaaggataagggatacattgtcttaaataggccttgggcgtttgtccagtggctgcagaaagcaaagatcgacgaagactatatactaatagcggagccagatcatatctttgtgaagcctttgccaaacttagcccatggtgatgaaccagcggcttttccatttttctacatcaaaccaaccgagaacgagaagatattgaggaagttctttccagaagaaaaaggacctgtctcaaaaatcgatcccattggcaactctccggttataatcaagaaggctcaacttgagaagattgcaacaacctggatgaatgtttcactacaaatgaaagaggatcaggagacagacaaagcatttggatgggtcttggaaatgtatgcatatgctgttgctagtgcactgcacggtgtgcaccatagtctccgtaaagattttatgattcagcctccttgggacctgaaatcagacaacacattcatcatccattacacatatggatgcgattattcgatgaagggtgagctaacttatgggaaaattggtgagtggcgttttgacaaaagatcttaccttcaatcaccaccaccaagaaatctttcactaccccctccaggagttcctgaaagtgtggtcacccttgtgaagatggtcaacgaggccacggcaaacattccagggtgggaggacgaaagataactgatggtattgctgagtcgtagcttgtttcagcttccagctagtatggtctttgttggaaaacatggaagagtaccactggccaattaaagaagagtattcaatctcatagtgtagggctggccaattttctacggtttaacataggttagtgtttgggaaggaaaagttatattcactttgatctagcgagtcacatcatttttgtattgtaaatcagaaatataggcttttggttactcttggttcattttgccacgttataaagcggagatgtagtttagaatcctccaatgcataccatgagaggtctgtaaaaactaaaaagtcatcttgggaaaaaatctgctggagtgctgacaacaaaaaaaaaaaaaaaaaaaa

SEQ ID NO: 526 - protein, 365 aa, Panicum virgatum
  misc_feature: Ceres CLONE ID no.1787953
  misc_feature: Bit score of 881.3 for HMM based on sequences of FIGURE 2.
  misc_feature: Functional Homolog Of Ceres SEEDLINE ID no. ME00045 at SEQ ID NO. 489
MSGRKNAGSTSPWMLILISLVCFFATYNFLTMPSRGWDGPRKFLGGGGGDRDSAVSYRSGSGSDPNKRFHVALTATDALYSQWQSRIMHYWYKEMRDRPGSDMGGFTRILHSGKPDGLMDEIPTMVVDPLPEGKDKGYIVLNRPWAFVQWLQKAKIDEDYILIAEPDHIFVKPLPNLAHGDEPAAFPFFYIKPTENEKILRKFFPEEKGPVSKIDPIGNSPVIIKKAQLEKIATTWMNVSLQMKEDQETDKAFGWVLEMYAYAVASALHGVHHSLRKDFMIQPPWDLKSDNTFIIHYTYGCDYSMKGELTYGKIGEWRFDKRSYLQSPPPRNLSLPPPGVPESVVTLVKMVNEATANIPGWEDER

SEQ ID NO: 527 - DNA, 1080 bp, Populus balsamifera subsp. trichocarpa
  misc_feature: Ceres ANNOT ID no.1531210
  misc_feature: Encodes the peptide sequence at SEQ ID NO 528
atgggttgtgggaatttcttctttacagtactaataaccttgtcagtagcccttataacatacaacatccttatatcagcaaacgcaccacttaaacaagacttaccaggtccatcatcaagatcaacacttttggttgacccagtaatcaagatgccattagaaagatcaagaagatcaagttttggtaaaaagagactgtttcatacagctgtgacagcttctgattctgtgtataatacttggcagtgtagggtaatgtattattggtacaagaagcataaagatggacccaatagtgagatgggagggttcactaggatcttgcattctggaaagcctgataagtttatggaggaaatcccaacttttatagcacagcccttgcctgctgggatggatcagggctatatagttctcaacagaccttgggcatttgtgcaatggcttcaaaaaacagacataaaagaagattacatattgatggcagagccagatcatattattgttaagcccatcccgaacctatctaaagatggccttggagctgcgtttcctttcttttacattgaaccaaaaaagtatgagtctgtcctccgaaagtacttccctgaggataagggaccaataacaaacatcgaccccataggaaattctcctgtcattgttgggaaggaatctcttaagaagattgctcccacttggatgaatgtctccttggcaatgaaaaaggatcccgagacagataaagcttttggctgggtgtatggttatgctgtttcatctgctctacatggcgttggcaacatcctgtacaaggacttcatgattcagcctccttgggatacagaagttggcaagaagttcataattcattacacttacggatgtgactatgatatgaagggtaaattaacctacggaaagattggagaatggaggtttgacaagagatcttatgataccgttatacccccaagaaaccttcccttgcctccaccgggtgttccagagagtgtggttactctggtgaaaatggtgaatgaagctactgcaaacattccaaattggggatcctaa

SEQ ID NO: 528 - protein, 359 aa, Populus balsamifera subsp. trichocarpa
  misc_feature: Ceres ANNOT ID no.1531210
  misc_feature: Bit score of 730.2 for HMM based on sequences of FIGURE 2.
  misc_feature: Functional Homolog Of Ceres SEEDLINE ID no. ME00045 at SEQ ID NO. 489
MGCGNFFFTVLITLSVALITYNILISANAPLKQDLPGPSSRSTLLVDPVIKMPLERSRRSSFGKKRLFHTAVTASDSVYNTWQCRVMYYWYKKHKDGPNSEMGGFTRILHSGKPDKFMEEIPTFIAQPLPAGMDQGYIVLNRPWAFVQWLQKTDIKEDYILMAEPDHIIVKPIPNLSKDGLGAAFPFFYIEPKKYESVLRKYFPEDKGPITNIDPIGNSPVIVGKESLKKIAPTWMNVSLAMKKDPETDKAFGWVYGYAVSSALHGVGNILYKDFMIQPPWDTEVGKKFIIHYTYGCDYDMKGKLTYGKIGEWRFDKRSYDTVIPPRNLPLPPPGVPESVVTLVKMVNEATANIPNWGS

SEQ ID NO: 529 - DNA, 1348 bp, Glycine max
  misc_feature: Ceres CLONE ID no.521176
  misc_feature: Encodes the peptide sequence at SEQ ID NO 530
gctctttcatcataaacaaagattcttctctattctccaactcttttgcttcttctttcaaagtggcatcaaaaactagaagaaaatggggtgtggcaatttgttcttcacagtcctcataaccttctcagtggcactcataacatacaacatcataatctctgccaatgcccctctcaagcaggacttcccaggcccctcacgcccctccatcaaggtggatcccctcatcaagatgccactccacagatcatcatcctcggagaaatcaaaaaagaggttgtttcacactgctgtcactgcctctgattctgtgtacaacacgtggcagtgcagagtgatgtactattggttcaagaagttcagggatggaggaggagacgaatccgggatggggggtttcacccggatcctgcactcggggaagcctgaccagttcatggatgagatccccacctttgttgctcagcctctgcctgctgggatggatcagggttacatagtccttaatagaccatgggcatttgtgcagtggcttcaacaagcagatattaaagaagattacatattgatgtcagagccagatcatataattgtcaaacctatacccaacttagccagagatgggctaggagctgcatttcctttcttttatattgagcctaagaagtatgaaactgtgctaaggaagtacttccctgacgagaagggaccaataaccaatattgatccaattgggaattcacctgttattgttggaaaggaattcctcaagaagattgctcccacatggatgaatgtttccctggcaatgaagaaggatcctgaaactgataaagcttttggatgggtgcttgaaatgtatgcttacgctgttgcatctgctcttcatggtgttcgtaacatattatacaaggacttcatgattcagcctccatgggatcaagaaattggcaagacatacataattcactacacttatggctgtgactatacaatgaagggtgagctaacctatggaaagattggagaatggagatttgataaaagatcttatgataaagttgctcccccaaagaatctgacattgccaccacccggtgttccagaaagtgtagtgactctcgtaaaaatggtgaatgaagctactgcaaatattccaaattggtggtcatagggaaggttaaaggtgttgcaaattacgatagttggagaatgcgttggacctatggccattttaaatggaagggcattgtacacgtcattgcttatgtatttatgcattcttcgaatatagtttgaccagtgagtgagacaaacctgtggaattgatatcactggtgcttct

SEQ ID NO: 530 - protein, 363 aa, Glycine max
  misc_feature: Ceres CLONE ID no.521176
  misc_feature: Bit score of 745.5 for HMM based on sequences of FIGURE 2.
  misc_feature: Functional Homolog Of Ceres SEEDLINE ID no. ME00045 at SEQ ID NO. 489
MGCGNLFFTVLITFSVALITYNIIISANAPLKQDFPGPSRPSIKVDPLIKMPLHRSSSSEKSKKRLFHTAVTASDSVYNTWQCRVMYYWFKKFRDGGGDESGMGGFTRILHSGKPDQFMDEIPTFVAQPLPAGMDQGYIVLNRPWAFVQWLQQADIKEDYILMSEPDHIIVKPIPNLARDGLGAAFPFFYIEPKKYETVLRKYFPDEKGPITNIDPIGNSPVIVGKEFLKKIAPTWMNVSLAMKKDPETDKAFGWVLEMYAYAVASALHGVRNILYKDFMIQPPWDQEIGKTYIIHYTYGCDYTMKGELTYGKIGEWRFDKRSYDKVAPPKNLTLPPPGVPESVVTLVKMVNEATANIPNWWS

SEQ ID NO: 531 - protein, 366 aa, Arabidopsis thaliana
  misc_feature: Public GI ID no.22327055
  misc_feature: Bit score of 727.9 for HMM based on sequences of FIGURE 2.
  misc_feature: Functional Homolog Of Ceres SEEDLINE ID no. ME00045 at SEQ ID NO. 489
MGCGGTLFYPLLITLSVALITYNIIISANAPLKQGFPGRSSSSDISIDPVIELPRGGGSRNNDGKRIRLFHTAVTASDSVYNTWQCRVMYYWFKKIQASAGPGSEMGGFTRILHSGKPDQYMDEIPTFVAQPLPSGMDQGYVVLNRPWAFVQWLQQTDIKEDYILMSEPDHIIVKPIPNLAKDGLGAAFPFFYIEPKKYEKVLRKYYPEVRGPVTNIDPIGNSPVIVGKDALKKIAPTWMNVSLAMKKDPEADKAFGWVLEMYAYAVSSALHGVSNILHKDFMIQPPWDIEVGDKYIIHYTYGCDYDMKGKLTYGKIGEWRFDKRSYDSKPPPRNLTMPPPGVSQSVVTLVKMINEATANIPNWGS

SEQ ID NO: 532 - DNA, 1071 bp, Populus balsamifera subsp. trichocarpa
  misc_feature: Ceres ANNOT ID no.1508824
  misc_feature: Encodes the peptide sequence at SEQ ID NO 533
atgggttgtggggatctcttcttttcactgcttataaccttctcagcagcccttataacatacaatatccttatatcagcaaatgcaccacttaagcaagaactaccgggtccatcatcaagatcatcacttttagttgacccaattatcaagatgccattcggaagatcaagttttggtaaaaagagactgtttcatacagctgtgacagcttctgattctgtgtataatacttggcagtgtagggtgatgtattattggtacaagaagcataaagatggacccaatagtgaaatgggtgggtttactaggatcttgcattctggaaagcctgacaagtttatggaggaaatcccgacttttatagcacagcctttgccttctgggatggatcagggctatatagttctcaacagaccttgggcatttgtgcaatggcttcaaaaagcagacataaaagaagattacatactgatggcagagccagatcatattattgttaagcccatcccaaacctatctaaagatggccttggagctgcatttcctttcttttacattgaacctaaaaagtatgaatctgtcctccgaaagtacttccctgaggataagggaccgataacaaccatcgaccccataggaaattctcctgtcattgttggaaaggaatctcttaagaagattgctcccacttggatgaatatctccttagcaatgaaaaaggatcctgaaacagataaagcttttggatgggtgtatgcttatgctgtttcatctgctctacatggtgttggtaacatcctgtacaaggacttcatgattcagcctccgtgggatacagaaattggcaagaagttcatcattcattacacttatggatgtgactatgatatgaagggtaaattaacctatggaaagattggagaatggaggtttgacaaaaggtcatatgataatgttgcacccccaagaaaccttcccttgcctccaccgggtgttccagatagtgtggttactctggtgaaaatggtgaatgaagctacttcaaacattccaaattggggatcctaa

SEQ ID NO: 533 - protein, 356 aa, Populus balsamifera subsp. trichocarpa
  misc_feature: Ceres ANNOT ID no.1508824
  misc_feature: Bit score of 724.2 for HMM based on sequences of FIGURE 2.
  misc_feature: Functional Homolog Of Ceres SEEDLINE ID no. ME00045 at SEQ ID NO. 489
MGCGDLFFSLLITFSAALITYNILISANAPLKQELPGPSSRSSLLVDPIIKMPFGRSSFGKKRLFHTAVTASDSVYNTWQCRVMYYWYKKHKDGPNSEMGGFTRILHSGKPDKFMEEIPTFIAQPLPSGMDQGYIVLNRPWAFVQWLQKADIKEDYILMAEPDHIIVKPIPNLSKDGLGAAFPFFYIEPKKYESVLRKYFPEDKGPITTIDPIGNSPVIVGKESLKKIAPTWMNISLAMKKDPETDKAFGWVYAYAVSSALHGVGNILYKDFMIQPPWDTEIGKKFIIHYTYGCDYDMKGKLTYGKIGEWRFDKRSYDNVAPPRNLPLPPPGVPDSVVTLVKMVNEATSNIPNWGS

SEQ ID NO: 534 - DNA, 1472 bp, Arabidopsis thaliana
  misc_feature: Ceres CLONE ID no.38879
  misc_feature: Encodes the peptide sequence at SEQ ID NO 535
aaaagcaatttagaacttataaaaaggaaagccatttcttcggcatcctcttcaccaactggcataagcagaagaagaagaagacaacgacgacgactttgaagaagaacaaactcttccttcaatctcaatctctcaatctctctctcagatgggttgtggtggaactttgttctacccacttctcataactctctccgttgctctaatcacttacaacatcatcatctccgctaatgctcctctcaaacaaggcttcccaggccgatcttcttcctccgatatctccattgacccagtcatcgaattgccacgtggcggcggatccagaaacaacgatggtaaaaggataagacttttccacacgtcggtgacggcgtctgattccgtctacaacacttggcaatgtagagttatgtactattggttcaaaaagattcaagcttctgctggacccggttctgaaatgggtgggtttactcggatcttacattccggtaaaccggatcagtatatggatgagattcctacttttgttgctcagcctttaccttctgggatggatcagggttatgttgtgttgaataggccatgggcatttgtacaatggcttcaacaaacagatattaaagaagattatattttgatgtctgagcctgatcatatcattgttaaacctataccaaatttggctaaagatgggcttggagctgcatttcctttcttttacattgaaccgaaaaagtatgagaaggtgttgaggaagtattatcctgaagtgagaggaccggttactaatatcgatccgataggaaactctcctgtcattgttggaaaggatgctttgaagaagattgctccaacttggatgaatgtttctttggctatgaagaaggatcctgaagcagacaaggcttttggatgggttcttgaaatgtatgcttatgctgtctcatctgcattgcatggtgttagcaatattctacacaaagacttcatgattcagcctccatgggatatagaggttggtgacaagtacatcatacactacacttatggatgtgattatgatatgaagggtaaattaacttatgggaaaatcggggaatggagatttgacaaaagatcgtatgatagcaaaccaccaccaaggaaccttacaatgcctccacctggtgtttcacaaagtgtggtaacactagtgaagatgataaatgaagccacggccaacataccaaactggggatcataaagagacagagagagagaaaccgtaatctatatgtacctgtgagttgctcctttcttttcaaaataccttgtcctgctctttagtttctcctttggttgtggctaggtttgtaacatatatagtgattcaaacaaagcctttctttggcatcttacttctctaattcggtctagtctccactagactctgatgtcctctagcatctcaaaggataaattac

SEQ ID NO: 535 - protein, 366 aa, Arabidopsis thaliana
  misc_feature: Ceres CLONE ID no.38879
  misc_feature: Bit score of 725.3 for HMM based on sequences of FIGURE 2.
  misc_feature: Functional Homolog Of Ceres SEEDLINE ID no. ME00045 at SEQ ID NO. 489
MGCGGTLFYPLLITLSVALITYNIIISANAPLKQGFPGRSSSSDISIDPVIELPRGGGSRNNDGKRIRLFHTSVTASDSVYNTWQCRVMYYWFKKIQASAGPGSEMGGFTRILHSGKPDQYMDEIPTFVAQPLPSGMDQGYVVLNRPWAFVQWLQQTDIKEDYILMSEPDHIIVKPIPNLAKDGLGAAFPFFYIEPKKYEKVLRKYYPEVRGPVTNIDPIGNSPVIVGKDALKKIAPTWMNVSLAMKKDPEADKAFGWVLEMYAYAVSSALHGVSNILHKDFMIQPPWDIEVGDKYIIHYTYGCDYDMKGKLTYGKIGEWRFDKRSYDSKPPPRNLTMPPPGVSQSVVTLVKMINEATANIPNWGS

SEQ ID NO: 536 - protein, 358 aa, Arabidopsis thaliana
  misc_feature: Public GI ID no.42569309
  misc_feature: Bit score of 715.1 for HMM based on sequences of FIGURE 2.
  misc_feature: Functional Homolog Of Ceres SEEDLINE ID no. ME00045 at SEQ ID NO. 489
MGFRGKYFFPILMTLSLFLIIRYNYIVSDDPPLRQELPGRRSASSGDDITYTVKTPSKKTKRLFHTAVTATDSVYSTWQCRVMYYWYNRFRDEPGSDMGGYTRILHSGRPDGLMDEIPTFVADPLPSGVDKGYVVLNRPWAFVQWLQQAHIEEDYILMAEPDHIIVKPIPNLARGNLAAAFPFFYIEPKKYESVLRKFFPKENGPISRIDPIGNSPVIVTKNALMKIAPTWMNVSLAMKNDPQTDKAFGWVLEMYAYAVSSALHGVSNILHKDFMIQPPWDTETKKTFIIHYTYGCDFDMKGKMMVGKIGEWRFDKRSYGDKPPPRNLTLPPRGVPESVVTLVTMINEATANIPNWES

SEQ ID NO: 537 - DNA, 1755 bp, Panicum virgatum
  misc_feature: Ceres CLONE ID no.1817784
  misc_feature: Encodes the peptide sequence at SEQ ID NO 538
cctgctgctggcctgctggccatctgatgatggagtggtgggtccgagcctacttgtaaaaaaggaagaaattcagcccttctcagttctctcgctcttcctctgcgacgagttctcctcgccttcccacgccatcaccgcggcggaggcgacagccgctgaccgctccgccctctccggccggccaccgcctgcctcgtcgtggcttcgcagtgactcccagattgcgggttggggcgtgaaggatgagcgggaggaagaatgccggaaggacctctccctggatgctcctcctcatctccctagtatgcttcttcgcgacctacaacttcctgacgatgcccagccggggttgggacgtgccgcacaagttcctcggcggcggcggggatcggggctcggccgtctcgtacaggtcgggctctggttcggcggcggaccccacgaagcggttccacgtcgcgctgacggcgacggacgcgctttacagccagtggcagtcccgtataatgcactattggtacaaggagatgaggggccggcctgggtccgacatgggcggcttcacaaggatccttcactcggggaagcctgatggattgatggatgagatacccaccatggtggttgacccgcttcctgaaggcaaggataagggatacattgtcttaaataggccttgggcgtttgtccagtggctgcagaaggcaaagatcgacgaagactatatactaatggcggagccagatcatgtctttgtgaagcctttgccaaacttagcccatggtgatgaaccagcggcttttccatttttctacatcaaaccaactgagaacgagaagatattgaggaagttctttccagaagaaaaaggacctgtctcaaaaatcgatcctattggcaactctccagttataatcaagaaggctcaactcgagaagattgcaacaacctggatgaatgtttcactaaaaatgaaagaggaccaggagacagacaaagcattcggatgggtcttggaaatgtatgcatacgctgttgctagtgcactgcacggtgtgcaccatagtctccgtaaagattttatgattcagcctccttgggacctgaaatcagacaacacattcatcatccattacacgtatggatgcgattattcgatgaagggtgagctaacttatgggaaaattggtgagtggcgttttgacaaaagatcttaccttcaatcaccaccaccaagaaatctttcactaccccctccaggagttcctgaaagtgtgagcacgatatcctctcttgtcagtcttgattactcgttcgtagcagttgatatgtgtgctgtgaattgaaattgacggcatggccggcacgagaaacagacgaggaggtgatggatcctgatttgaagttgaaacctgccgcttgtgctctgaagcgtgctcttctagtggcactgcgatgcgatgtgtcgacccagatgctgaggaaaaaaaatctattatgggtcaagttggcgggatgcttgaagccgaatatgtcgtcatgagaataaaaaaaatatcatcatgggagctttgtacaggatcctcggtttgcatttctggagggcattgcattttgtactgtacaatatgaattatccttccctagtttcctttgtggtagccagcttagagagcagaatcggatcgattccctgaccctgagggctgaaagattgaaactactgtgaatcctattcctattctgtctgtc

SEQ ID NO: 538 - protein, 367 aa, Panicum virgatum
  misc_feature: Ceres CLONE ID no.1817784
  misc_feature: Bit score of 817.8 for HMM based on sequences of FIGURE 2.
  misc_feature: Functional Homolog Of Ceres SEEDLINE ID no. ME00045 at SEQ ID NO. 489
MSGRKNAGRTSPWMLLLISLVCFFATYNFLTMPSRGWDVPHKFLGGGGDRGSAVSYRSGSGSAADPTKRFHVALTATDALYSQWQSRIMHYWYKEMRGRPGSDMGGFTRILHSGKPDGLMDEIPTMVVDPLPEGKDKGYIVLNRPWAFVQWLQKAKIDEDYILMAEPDHVFVKPLPNLAHGDEPAAFPFFYIKPTENEKILRKFFPEEKGPVSKIDPIGNSPVIIKKAQLEKIATTWMNVSLKMKEDQETDKAFGWVLEMYAYAVASALHGVHHSLRKDFMIQPPWDLKSDNTFIIHYTYGCDYSMKGELTYGKIGEWRFDKRSYLQSPPPRNLSLPPPGVPESVSTISSLVSLDYSFVAVDMCAVN

SEQ ID NO: 539 - DNA, 1573 bp, Zea mays
  misc_feature: Ceres CLONE ID no.284637
  misc_feature: Encodes the peptide sequence at SEQ ID NO 540
aaaaactgccaaacactgcacactcgggagtcaggactgggccgtttcagtgtcacttccgccgccttctccctcaatcaagagcgcccgtcccttcgcccgcgcgccccgccatggccgcgccgtgcggccgcggcggcggcacgctgacgctggtcctcgtggctctctccgcggcgttcctcacctacaacgtgctcatctccttccactcctccctccagcccctcccttcctccttccccaccgccaccgcctcccgccgcttcggcgccgcggggtctgccaggcggagggcgttccacaccgcggtgaccgcgtcagggtccgcgtacaacacgtggcagtgccgcgtcatgtaccactggttcaaggaggcgcgccgggcgccgggcggcgacgagatgggcgggttcaccaggatcctgcactccgggaaacccgacgagttcgtcgatgagatccccacattcgtcgccgacccactccccgatggggatcagggatacatcgttctcaataggccatgggcatttgttcagtggctccagaaagcagacataaaggaagactatattttgatggcagagccagatcacataattgtcaagcctatcccaaacttgtcgagagatggtcaggcagcagcttttcctttcttttacattgagcctaaaaaatatgagaatgtgttgcgtaagttcttccctgaagacaaggggtcaatcactaagatcgatcctataggaaactctcctgtcattattgagaaggagtctcttggaaggattgcaccgacttggatgaatgtttcattagcaatgaaaaaagatcctgacgcagataaatcttttggctgggttcttgaaatgtatgcctatgccgtggcatctgctctccatggagtgggcaacatcttacgcaaggactttatgattcagccaccttgggacttggaagttggtgattcttttattattcattatacttatgggtgtgattatgacatgacgggtaagctgacttatggcaaaattggtgaatggagatttgacaagagatcatacacggacaaacctccacctagaaatttgccgttaccaccacatggtgtagctcaaagtgtggtgacacttgtgaaaatggtcaatgaagcaacagccaacataccaaactgggactcctatgccgctgctttttaacctgttataaatttggctcacaattttgtttgccagatatttccattccagctgactttgatacatgataattgcctaacatggaagatgagtggatgatacagtggaatgcataccaggttttacacaaggctgccggttccttacctttctgattgaatcctgataatatatggtgcaatgccatccctttccccccctaattttgttaaacacatgcacatcagcacatggcacaatatgtcaaaacacactcacctttggtgaaagctgcaatgtagatgactgagagatgtgatgttcttatctggatctgaatgtgcttattagaagaagaaaaaaaagagtcaggcgctgctctgacaaacgct

SEQ ID NO: 540 - protein, 362 aa, Zea mays
  misc_feature: Ceres CLONE ID no.284637
  misc_feature: Bit score of 708.9 for HMM based on sequences of FIGURE 2.
  misc_feature: Functional Homolog Of Ceres SEEDLINE ID no. ME00045 at SEQ ID NO. 489
MAAPCGRGGGTLTLVLVALSAAFLTYNVLISFHSSLQPLPSSFPTATASRRFGAAGSARRRAFHTAVTASGSAYNTWQCRVMYHWFKEARRAPGGDEMGGFTRILHSGKPDEFVDEIPTFVADPLPDGDQGYIVLNRPWAFVQWLQKADIKEDYILMAEPDHIIVKPIPNLSRDGQAAAFPFFYIEPKKYENVLRKFFPEDKGSITKIDPIGNSPVIIEKESLGRIAPTWMNVSLAMKKDPDADKSFGWVLEMYAYAVASALHGVGNILRKDFMIQPPWDLEVGDSFIIHYTYGCDYDMTGKLTYGKIGEWRFDKRSYTDKPPPRNLPLPPHGVAQSVVTLVKMVNEATANIPNWDSYAAAF

SEQ ID NO: 541 - protein, 364 aa, Oryza sativa subsp. japonica
  misc_feature: Public GI ID no.125596251
  misc_feature: Bit score of 708.7 for HMM based on sequences of FIGURE 2.
  misc_feature: Functional Homolog Of Ceres SEEDLINE ID no. ME00045 at SEQ ID NO. 489
MAAPCRGSRGALPLLLISLSAAYLTYTALLSSRSLLPLPTASFPGATASRRLASGRPTAAAAFHTAVTASGSLYNTWQCRVMYYWFKRAREAGGGGGAEMGGFTRILHSGKPDAFVDEIPTFVADPLPAGTDQGYVVLNRPWAFVQWLQKADIQEEYILMAEPDHLIVKPIPNLSRDGRSAAFPFFYIEPKKYENVLRKFFPEHEGPITKIDPIGNSPVIARKESLARIAPTWMNISIAMKKDPETDKAFGWVLEMYAYAVASALHGVGNILHKEFMIQPPWDLEIGDAFIIHYTYGCDYDMKGKLTYGKIGEWRFDKRSYDSKPPPRNLPLPPNGVPQSVVTLVKMVNEATANIPNWDSYAAA

SEQ ID NO: 542 - DNA, 1233 bp, Populus balsamifera subsp. trichocarpa
  misc_feature: Ceres ANNOT ID no.1509601
  misc_feature: Encodes the peptide sequence at SEQ ID NO 648
atgacaaaccaaaatgtggtagtggctgatacaaactctggactcaacttggcaatcacagtgcatgtaacaaactcctctatcttcacaacggcggcccagaaacctccagcggcaccaggtggttacatatccatttctagaaagaaactcttaaagaatctggaaatcaatggaggagcaagaattaatgcttgggttgattccatgagagcctcatctcctactcatatcaagtccacgccttctgttaatgaagaccaaagctcatggattcttcaccacccatcagcactggagatgtttgagcagataattgatgcctctaaaggaaagcaaattgttatgttcttggactatgatggcacactttctcctattgttgatgacccagataaagctttcatgtccaagcaggtgatgagagcaacagtgagaaagcttgcaagatttttccctactgcaatagtgagtgggaggtgcagagacaaggtgtataactttgtacggttagcagaactgtactatgctggaagccatggcatggacattaaaggaccagcaaaaggctccaaatacaagaaagctgccagtgaatttcttcccatgatagatgaggtttacgaagaattggtagagaaaactaaaacaactccaggggccaaggtggagaacaacaaattctgcctctctgtgcactatcgctgcgttgatgagaaaaaatggagtggactggcacaagtagttaagtcagtgttgaaggagtacccaaagcttcgacttactcaaggaagaaaggttttagaaatccgccctaccattaaatgggacaaaggaaaggctcttgaatttttgttagagtcacttggattcgccaattgcactgatgtttttcctgtttacattggagatgatagaacagacgaagatgcatttaaggtactaagagagagaggacaaggttttggtatcttggtctctaaaatcccaaaggacactagtgcatcttattccctacaggaacccacccaggcaacttggcatgctttagctcaaacacacttgcatgtgcttgggacctcaaatcgcaaacaaagccccaaatttttcacaaacgatgcttgtaagagaaaggtccttgagcccacggttgccagctttgtgaatattcctttgctaataatttcgaaggctacccccgctagaaggttgaggaagggaggtatcgtgtga

SEQ ID NO: 543 - protein, 364 aa, Oryza sativa subsp. indica
  misc_feature: Public GI ID no.125554300
  misc_feature: Bit score of 707.3 for HMM based on sequences of FIGURE 2.
  misc_feature: Functional Homolog Of Ceres SEEDLINE ID no. ME00045 at SEQ ID NO. 489
MAAPCRGSRGALPLLLISLSAAYLTYTGLLSSRSLLPLPTASFPGATASRRLASGRPTAAAAFHTAVTASGSLYNTWQCRVMYYWFKRAREAGGGGGAEMGGFTRILHSGKPDAFVDEIPTFVADPLPAGTDQGYVVLNRPWAFVQWLQKADIQEEYILMAEPDHLIVKPIPNLSRDGRSAAFPFFYIEPKKYENVLRKFFPEHEGPITKIDPIGNSPVIARKESLARIAPTWMNISIAMKKDPETDKAFGWVLEMYAYAVASALHGVGNILHKEFMIQPPWDLEIGDAFIIHYTYGCDYDMKGKLTYGKIGEWRFDKRSYDSKPPPRNLPLPPNGVPQSVVTLVKMVNEATANIPNWDSYAAA

SEQ ID NO: 544 - DNA, 1124 bp, Gossypium hirsutum
  misc_feature: Ceres CLONE ID no.1935437
  misc_feature: Encodes the peptide sequence at SEQ ID NO 545
aagacttccgcgttttccaccattgccgttgaatagaagaaactaaaccccaaatctctcccatgccttcagattctttctttggatttctgagggatttatgatcaattgtctgggatttttcagtaaaggatgttgttcgaaaagcataaattgaattaggcgttgcggctgtgagaagggctgggttttgtattgtgtagtgaaagatgaagcgcgtttcgccgctctttttggtacttttagtccttggattcttctttgcaacatataatttgttgactatgataatacactataagacatatacttcagagcaatgggatttctccaatccttttatacaaatgccttggaatttgatggaaggtgagggttctaactcaaagtaccacgttgctctcacggcaacagatgctccgtatagccaatggcagtgtcggattatgtattattggtataagaaggtaaaagagatgcctggatcagatatgggaaagttcactcgaattttgcattcagggaagcccgacaatttgatggaggagattccaacttttgtcgttgaccctcttccagagggtttagatcggggttatattgtcttaaatagaccatgggcttttgtgcaatggctggaaaaagcaatgattgacgaagaatacattctaatggccgaacctgaccatgtatttgtaaatcctttgcctaacttggctcgtggaaaacatccagcagggtttcctttcttttacattaagccatctgaccacaagcatgttattaggaagtattatcctgaggagaagggtcctgtgacgaatattgatccaattggcaattctccagtgattattaaaaagtctgtgctggagaaaattgcacctacatggatgaatatttctttgaggatgaaagatgacccagtgactgacaaggaatttggatgggtgctagaaatgtatgcgtatgctgtggcatctgcactgcatgacgtgcaccacatactttataaagacttcatgctccagccaccatgggatacggaagtagggaagaagtctataatccattatacttacggatgtgactacaatttgaagggagaaataacatatggaaag

SEQ ID NO: 545 - protein, 305 aa, Gossypium hirsutum
  misc_feature: Ceres CLONE ID no.1935437
  misc_feature: Bit score of 626.8 for HMM based on sequences of FIGURE 2.
  misc_feature: Functional Homolog Of Ceres SEEDLINE ID no. ME00045 at SEQ ID NO. 489
MKRVSPLFLVLLVLGFFFATYNLLTMIIHYKTYTSEQWDFSNPFIQMPWNLMEGEGSNSKYHVALTATDAPYSQWQCRIMYYWYKKVKEMPGSDMGKFTRILHSGKPDNLMEEIPTFVVDPLPEGLDRGYIVLNRPWAFVQWLEKAMIDEEYILMAEPDHVFVNPLPNLARGKHPAGFPFFYIKPSDHKHVIRKYYPEEKGPVTNIDPIGNSPVIIKKSVLEKIAPTWMNISLRMKDDPVTDKEFGWVLEMYAYAVASALHDVHHILYKDFMLQPPWDTEVGKKSIIHYTYGCDYNLKGEITYGK

SEQ ID NO: 546 - DNA, 1095 bp, Populus balsamifera subsp. trichocarpa
  misc_feature: Ceres ANNOT ID no.1455622
  misc_feature: Encodes the peptide sequence at SEQ ID NO 547
atgggttgtggggatctcttcttttcactgcttataaccttctcagcagcccttataacatacaatatccttatatcagcaaatgcaccacttaagcaagaactaccgggtccatcatcaagatcatcacttttagttgacccaattatcaagatgccattcggaagatcaagttttggtaaaaagagactgtttcatacagctgtgacagcttctgattctgtgtataatacttggcagtgtagggtgatgtattattggtacaagaagcataaagatggacccaatagtgaaatgggtgggtttactaggatcttgcattctggaaagcctgacaagtttatggaggaaatcccgacttttatagcacagcctttgccttctgggatggatcagtctattgatgatttgaaacccttaggtaaggttaagactgcttatgtacttgcttggttgctgaagaaacctaggcaaagaagttacatactgatggcagagccagatcatattattgttaagcccatcccaaacctatctaaagatggccttggagctgcatttcctttcttttacattgaacctaaaaagtatgaatctgtcctccgaaagtacttccctgaggataagggaccgataacaaccatcgaccccataggaaattctcctgtcattgttggaaaggaatctcttaagaagattgctcccacttggatgaatatctccttagcaatgaaaaaggatcctgaaacagataaagcttttggatgggtgcttgaaatgtatgcttatgctgtttcatctgctctacatggtgttggtaacatcctgtacaaggacttcatgattcagcctccgtgggatacagaaattggcaagaagttcatcattcattacacttatggatgtgactatgatatgaagggtaaattaacctatggaaagattggagaatggaggtttgacaaaaggtcatatgataatgttgcacccccaagaaaccttcccttgcctccaccgggtgttccagatagtgtggttactctggtgaaaatggtgaatgaagctacttcaaacattccaaattggggatcctaa

SEQ ID NO: 547 - protein, 364 aa, Populus balsamifera subsp. trichocarpa
  misc_feature: Ceres ANNOT ID no.1455622
  misc_feature: Bit score of 659.4 for HMM based on sequences of FIGURE 2.
  misc_feature: Functional Homolog Of Ceres SEEDLINE ID no. ME00045 at SEQ ID NO. 489
MGCGDLFFSLLITFSAALITYNILISANAPLKQELPGPSSRSSLLVDPIIKMPFGRSSFGKKRLFHTAVTASDSVYNTWQCRVMYYWYKKHKDGPNSEMGGFTRILHSGKPDKFMEEIPTFIAQPLPSGMDQSIDDLKPLGKVKTAYVLAWLLKKPRQRSYILMAEPDHIIVKPIPNLSKDGLGAAFPFFYIEPKKYESVLRKYFPEDKGPITTIDPIGNSPVIVGKESLKKIAPTWMNISLAMKKDPETDKAFGWVLEMYAYAVSSALHGVGNILYKDFMIQPPWDTEIGKKFIIHYTYGCDYDMKGKLTYGKIGEWRFDKRSYDNVAPPRNLPLPPPGVPDSVVTLVKMVNEATSNIPNWGS

SEQ ID NO: 548 - protein, 283 aa, Oryza sativa subsp. japonica
  misc_feature: Public GI ID no.55771354
  misc_feature: Bit score of 558.5 for HMM based on sequences of FIGURE 2.
  misc_feature: Functional Homolog Of Ceres SEEDLINE ID no. ME00045 at SEQ ID NO. 489
MYYWFKRAREAGGGGGAEMGGFTRILHSGKPDAFVDEIPTFVADPLPAGTDQGYVVLNRPWAFVQWLQKADIQEEYILMAEPDHLIVKPIPNLSRDGRSAAFPFFYIEPKKYENVLRKFFPEHEGPITKIDPIGNSPVIARKESLARIAPTWMNISIAMKKDPETDKAFGWVLEMYAYAVASALHGVGNILHKEFMIQPPWDLEIGDAFIIHYTYGCDYDMKGKLTYGKIGEWRFDKRSYDSKPPPRNLPLPPNGVPQSVVTLVKMVNEATANIPNWDSYAAA

SEQ ID NO: 549 - DNA, 915 bp, Populus balsamifera subsp. trichocarpa
  misc_feature: Ceres ANNOT ID no.1514655
  misc_feature: Encodes the peptide sequence at SEQ ID NO 550
atggggcgagcgtcgccattgctattggtgcttttggcactagggtttttctttgccacgtataacttgttgactttgataatacagtataaggattctagtacaggacttggatcagggatttctgatcctgttacagggatgccagccaattcttggaaattagggaagtcaaatttgaaattccatgttgctcttacggctactgatgctccttatagtcaatggcaatgccgggttatgtattattggtataagaaaatgaaaagcatgccaggatcagacatgggaaagttcactcgagttttgcattcggggaaaggtgatcatttgatggatgagattccaacttttattgttgatcctcttccagacggcctagatcggggatatattgtcttgaatagaccatgggcttttgtgcaatggctggaaaaggcaacaattgaggaagactacattctaatggcagagcctgaccacatattcgcaaatcctttgcctaacttggcacatggagataatccagcagggtttccatttttctatattaaaccaactgaacatgagaaaattgttagaaagttttatcctgaggagaagggtcctgtgacagatgttgatccaattggcaattcccctgtaataataaaaaagcctccatgggatttggaagttggtaagagatttatcatccactatacttatggatgcgactataatatgaagggagaattaacatatggaaagattggagaatggcggtttgacaagagatcctatctcagtggtcctccaccaaagaacctcaccctgcccccaccaggagttcctgaaagcgtggtgagacttgtaaagatggtgaatgaggctacagctaacattccaggctgggactcattgaacagtggctga

SEQ ID NO: 550 - protein, 304 aa, Populus balsamifera subsp. trichocarpa
  misc_feature: Ceres ANNOT ID no.1514655
  misc_feature: Bit score of 639.4 for HMM based on sequences of FIGURE 2.
  misc_feature: Functional Homolog Of Ceres SEEDLINE ID no. ME00045 at SEQ ID NO. 489
MGRASPLLLVLLALGFFFATYNLLTLIIQYKDSSTGLGSGISDPVTGMPANSWKLGKSNLKFHVALTATDAPYSQWQCRVMYYWYKKMKSMPGSDMGKFTRVLHSGKGDHLMDEIPTFIVDPLPDGLDRGYIVLNRPWAFVQWLEKATIEEDYILMAEPDHIFANPLPNLAHGDNPAGFPFFYIKPTEHEKIVRKFYPEEKGPVTDVDPIGNSPVIIKKPPWDLEVGKRFIIHYTYGCDYNMKGELTYGKIGEWRFDKRSYLSGPPPKNLTLPPPGVPESVVRLVKMVNEATANIPGWDSLNSG

SEQ ID NO: 551 - DNA, 966 bp, Gossypium hirsutum
  misc_feature: Ceres CLONE ID no.1848736
  misc_feature: Encodes the peptide sequence at SEQ ID NO 552
tttgactttcttgtttggttcttgattaggtctcaagatttccttgatctccatcctttctgagctcgtttttaagcagtttggactttggaggatcggagatcgtggtcgatgatatcgagaaagaacatgggaagtgcttcgccgctcctactcattacattagttcttggtgtttgctttgccacatataatcttgtaacaatggtaatgcacaatagatctatttcaaaactgacaatctataactccgatggtggaatatttgttgatcccatcattgagatgcccgaaagtgtgaggaaattgaagcgtgccaaaatgcctttccatgttgccttaactgccactgatgctccctacagcaaatggcagtgtcgtatcatgtactattggtataagaagcagaaggacttacctgggtcggagatgggaggtttcactcgtattttacactctggaaatcctgacaatttgatgaacgagattcctactgtcatagtcgatcctcttccagcagggcttgatcggggatacatcgtcttaaatcgaccatgggcttttgtgcaatggctggaaaaggctacaattgaagaagaatacgtattgatggcagagcctgaccacatttttgtcactcccctacctaatctagcacatggaggatacccggctgcattcccctttttctacattaagccggatcagaacgaaaagttgttaaggaagtttttcccggaggagatgggaccggtgacaaatattgatccaatcggcaattcacccgtcattatcaagaaggaattattggaaaaaatcgctcctacttggatgaatgtttctttaaaaatgaaggatgatcccgagactgataaaacttttggatgggtgctacaaatgtatgcttatgctgtgacatctgctttgcatgacgtgcaacaagtacctaaaaaagacttcaagctt

SEQ ID NO: 552 - protein, 285 aa, Gossypium hirsutum
  misc_feature: Ceres CLONE ID no.1848736
  misc_feature: Bit score of 568.6 for HMM based on sequences of FIGURE 2.
  misc_feature: Functional Homolog Of Ceres SEEDLINE ID no. ME00045 at SEQ ID NO. 489
MISRKNMGSASPLLLITLVLGVCFATYNLVTMVMHNRSISKLTIYNSDGGIFVDPIIEMPESVRKLKRAKMPFHVALTATDAPYSKWQCRIMYYWYKKQKDLPGSEMGGFTRILHSGNPDNLMNEIPTVIVDPLPAGLDRGYIVLNRPWAFVQWLEKATIEEEYVLMAEPDHIFVTPLPNLAHGGYPAAFPFFYIKPDQNEKLLRKFFPEEMGPVTNIDPIGNSPVIIKKELLEKIAPTWMNVSLKMKDDPETDKTFGWVLQMYAYAVTSALHDVQQVPKKDFKL

SEQ ID NO: 553 - protein, 288 aa, Oryza sativa subsp. japonica
  misc_feature: Public GI ID no.125569872
  misc_feature: Bit score of 572.1 for HMM based on sequences of FIGURE 2.
  misc_feature: Functional Homolog Of Ceres SEEDLINE ID no. ME00045 at SEQ ID NO. 489
MPGWMRAAGSAGGGRRRPFHVALTATDAAYSRWQCRVMYYWYKRMQARPEGADMGGFTRVLHSGKPDALMGEIPTFVVDPLPAGKDHGYVVLNRPWAFVQWLEKAKIEEEYILMAEPDHIFVRPLPNLARDDPAAFPFFYITPSEHESVLRKYYPKERGPVTNIDPIGNSPVIIKKIQLEKIAPTWMNVSIQMKEDQETDKAFGWVLEMYAYAVASALHGVQHILRKDFMIQGVLTYGKIGEWRFDKRAYQDRPPPRNLTLPPPGVPESVDVGKYGREVIYALESIDV

SEQ ID NO: 554 - DNA, 1862 bp, Glycine max
  misc_feature: Ceres CLONE ID no.1645078
  misc_feature: Encodes the peptide sequence at SEQ ID NO 555
gtgagcttagtggagaaaagctagatatagccacctcttcaaagttcaaaacttccctttttggttctagtttgcatcttattcattttccctgcatttctatgcttcaaactattcttctttttttgtctaaattttccttctgtctttttttctgactcaaagtttgaacttttcctatgggggtaccttgaattgtgtagaacatcagttttttatgtgaaattttattctagttcaagtatgggctggtgttcttatttttacatggatttcagtttctaggatttttttctgcacaaatcactaatggcaacatttgaagcaaggagtgatctcaattgagtacatttttatgaacagaacctatgattgtggttagctttagtagggctgaatggggtttatttaacagctgttataggtagaatttagttggtttgagttttggagatttagagaatccatattagaataacaaaataagtaaagaatatgattgtgaggaaaaacaagccaagtgcaaggtcactacttatgctttttgttatggttcttgcttttctctttgtcacttataatttggtgtttataatcaaacaccatatgggtggaacttgggtagcagaagagttgaggtttcttgatcctgtgatcagcatgcctggaaaggtgatggcattagcaaattccaattcaaaatttcatgttgcagtgaccgcaaccgatgcggcttacagccaatggcaatgccggattatgtactattggtataagaaggttaaagatatgcctggatcagacatgggaaagttcaccagaatagtgcactcaggaaggcaagatcagttgatggatgagattcctacttttgtggttgatccacttcctgaaggcttggataggggttatgttgtcatgaatagaccatgggcttttgttcagtggctggagaaagcagacattgaggaagaatatattttgatggcagaacctgaccacatatttgtaaatcctttgccaaatttgactaatggaaaccaaccagcagggtatccatttttctatataaaaccagttaaacatgaaaaaatacttaggaaattctaccctaaggcgaatggtcctattactgctattgatcccattggcaattctcctgtaatcattcagaagtccttgctagaggaaatagctcccacatgggtgaatatttccttgcaaatgaaagatgatccggcaactgacgaaacttttggatgggtacttgaaatgtatgcgtacgctgtggcatcagctttgcacggtgtacggcatattcttcatgataacttcatgctccaggtttgtttatatgtgaatgggaattgcatctttacttgaggagggggaactaacatatgggaagattggagaatggcgttttaacaagagattttatctatcaggtcctccacccaaaaacctttccttaccccctcctggagttcctgaaagtgtggtgcagcttgtaaagatgatcaatgaggctactgctaacatacctaaatgggattctttaaatagaagctaaggaaaagaaaataaagtgcaaggtctaaggcccctcatgctagtggctactagatgagaaacaacaattctgattacatgaaaatagaccagtttaacccagagaagaactatgatgaacacagaaatatgtttttgtgctagctctgaaaatagttttttttttagcaagtaaattgttggtattgaaacatataaaaacaatgacagttgatcagacaacattttccaaaagatttttgtcagagggaaatcaatggaaacatcttgtcaaaaaaaaaaaaaaaaaa

SEQ ID NO: 555 - protein, 295 aa, Glycine max
  misc_feature: Ceres CLONE ID no.1645078
  misc_feature: Bit score of 475.5 for HMM based on sequences of FIGURE 2.
  misc_feature: Functional Homolog Of Ceres SEEDLINE ID no. ME00045 at SEQ ID NO. 489
MIVRKNKPSARSLLMLFVMVLAFLFVTYNLVFIIKHHMGGTWVAEELRFLDPVISMPGKVMALANSNSKFHVAVTATDAAYSQWQCRIMYYWYKKVKDMPGSDMGKFTRIVHSGRQDQLMDEIPTFVVDPLPEGLDRGYVVMNRPWAFVQWLEKADIEEEYILMAEPDHIFVNPLPNLTNGNQPAGYPFFYIKPVKHEKILRKFYPKANGPITAIDPIGNSPVIIQKSLLEEIAPTWVNISLQMKDDPATDETFGWVLEMYAYAVASALHGVRHILHDNFMLQVCLYVNGNCIFT

SEQ ID NO: 556 - DNA, 1324 bp, Panicum virgatum
  misc_feature: Ceres CLONE ID no.1790573
  misc_feature: Encodes the peptide sequence at SEQ ID NO 557
ttccctctactgcaccgagttctcctcttctccttcccggccgcgccacgcacggcacgccatcgccgcggcggaggcccgcgagaccggccggccagcgccggccttgtcgcggctcccaggtgactcccgcgatcggccccccgccggcgccgcggcgcacggctcgactgaagtagcggcgcccccgccccctggttgcgggtgtcgaggatgagcgggaggaagaatgccggcaggacctccccctggctgctcatcctcatctccgcagggtgcttcttcgcgacctataacttcctgacgatgcacggccggggccgggacgcgccgcgcaagcggttccacgttgcgctgacggcgacggacgcgctctacagccagtggcagtcccggatcatgcactactggtacaaggagatgagggacggccccggctccgacatgggcggcttcacacggatccttcactcggggaaacctgatgggttgatggacgagatacccaccatggtggtggacccgcttcctgaaggcacggataagggatacattgtcttaaataggccttgggcatttgtccagtggctgcagagagcaaagattgatgaagagtatatactaatggcggagccagatcatgtctttgtgaagcctttgccaaacttagctcatggtgatgaaccagcggcgtttccatttttctacatcaacccaactcagaatgagaagatattgcggaagttttttccagaagaaaaagggcctgtctcaaaaattgatcctattggcaactctccagttataataaagaaggcccaacttgagaagattgctccaacctggatgaatgtttcattaaaaatgaaagaggatcaggatacagacaaagcttttggatgggtcttggaaatgtatgcatatgctgttgctagtgcactgcatggtgtgcaccatagtctccgtaaagatttcatgattcaggtgctaagtcttgtcactagataattaatcgcatattgaagtgatggcagtttatatcattaaagatgtgcttgataataactgcagcctccttgggacctaaaaacagacaacacattcattatccattatacatatggatgtgattatacaatgaagggtcagctaacttatgggaaaattggtgaatggcgttttgacaaaagatcttatcttgaatcaccaccaccaagaaatctttcactaccccctcctggagttcctgaaagtgtggccacccttgtgaagatggtgaatgaggccactgcaaacattccagggtgggaggatgagagataat

SEQ ID NO: 557 - protein, 264 aa, Panicum virgatum
  misc_feature: Ceres CLONE ID no.1790573
  misc_feature: Bit score of 523.4 for HMM based on sequences of FIGURE 2.
  misc_feature: Functional Homolog Of Ceres SEEDLINE ID no. ME00045 at SEQ ID NO. 489
MSGRKNAGRTSPWLLILISAGCFFATYNFLTMHGRGRDAPRKRFHVALTATDALYSQWQSRIMHYWYKEMRDGPGSDMGGFTRILHSGKPDGLMDEIPTMVVDPLPEGTDKGYIVLNRPWAFVQWLQRAKIDEEYILMAEPDHVFVKPLPNLAHGDEPAAFPFFYINPTQNEKILRKFFPEEKGPVSKIDPIGNSPVIIKKAQLEKIAPTWMNVSLKMKEDQDTDKAFGWVLEMYAYAVASALHGVHHSLRKDFMIQVLSLVTR

SEQ ID NO: 558 - protein, 303 aa, Arabidopsis thaliana
  misc_feature: Public GI ID no.4567251
  misc_feature: Bit score of 423.8 for HMM based on sequences of FIGURE 2.
  misc_feature: Functional Homolog Of Ceres SEEDLINE ID no. ME00045 at SEQ ID NO. 489
MGFRGKYFFPILMTLSLFLIIRYNYIVSDDPPLRQELPGRRSASSGDDITYTVKTPSKKTKRLFHTAVTATDSVYSTWQCRVMYYWYNRFRDEPGSDMGGYTRILHSGRPDGLMDEIPTFVADPLPSGVDKKYESVLRKFFPKENGPISRIDPIGNSPVIVTKNALMKIAPTWMNVSLAMKNDPQTDKAFGWVLEMYAYAVSSALHGVSNILHKDFMIQPPWDTETKKTFIIHYTYGCDFDMKGKMMVGKIGEWRFDKRSYGDKPPPRNLTLPPRGVPESVVYIYSFKQNFSHLFPFGFLAQS

SEQ ID NO: 559 - protein, 384 aa, Arabidopsis thaliana
  misc_feature: Public GI ID no.30696058
  misc_feature: Bit score of 948.3 for HMM based on sequences of FIGURE 9.
  misc_feature (123)..(367): Pfam Name: Trehalose_PPase Pfam Description: Trehalose-phosphatase
  misc_feature: Functional Homolog Of Ceres SEEDLINE ID no. ME20095 at SEQ ID NO. 1129
MDMKSGHSSPVMTDSPPISNSRLTIRQNRLPYSSAAATAISQNNNLLLTVPRKKTGILDDVKSNGWLDAMKSSSPPPTILNKDNLSNDATDMTYREWMLKYPSALTSFEKIMSFAKGKRIALFLDYDGTLSPIVEEPDCAYMSSAMRSAVQNVAKYFPTAIISGRSRDKVYEFVNLSELYYAGSHGMDIMSPAGESLNHEHSRTVSVYEQGKDVNLFQPASEFLPMIDKVLCSLIESTKDIKGVKVEDNKFCISVHYRNVEEKNWTLVAQCVDDVIRTYPKLRLTHGRKVLEIRPVIDWDKGKAVTFLLESLGLNNCEDVLPIYVGDDRTDEDAFKVLRDGPNHGYGILVSAVPKDSNAFYSLRDPSEVMEFLKSLVTWKRSMG

SEQ ID NO: 560 - DNA, 944 bp, Zea mays
  misc_feature: Ceres CLONE ID no.444113
  misc_feature: Encodes the peptide sequence at SEQ ID NO 561
aaataagaattgtttaagctgttttttatgagtctagagatctgttgtaggacgaaacgagttctttgtcctgggcctttgtcactcttctctgtgtaacgacttcctccctttcctgccgcaccacgcaatcaccggggcggaggcggctgccggcgagcacttgggcgtctccggccaccgcctgcctcgttgtgatccaactaggaactcacccagcgctatctcccggcaggctccccgttgactcccgcgatttgttacccgctggcgctgccgcacacagctcaaaaggagtagcagcgcccctggttgccggttggagcgtcaaggatgagcgggaggaagaatgcgggcaaggtttccccctggttgctcgtcctcatctgtttagggtgcttctttgtgacctacaacctcctgacgatgcccagccggggacgggatgggccgcgcaagttcctcggcggcggcggggatcgccactcaactgcctcgttggggtcaggctctgattcggaccccgcgaagcggttccacgtcgcgcttacggcgacggacgcactgtacagtcagtggcagtcgcggataatgcactactggtataaggagatgagggaccgacctggttccgacatgggtggcttcactaggatccttcactcgggcaagcctgatggattgatggatgagatacccaccatggtggttgatccccttcctgaaggcaaggatcagggatatattgtcttaaataggccttgggcttttgtccagtggatccagaaagcaaagatcgtagaagagtatatattaatggcagagccagatcatgtctttgtgaagcctttgccaaacttatctcatggtgatgagccagcggcatttccatttttctacatcaaaccgactgagaatgagaagatattgagggagttttttcc

SEQ ID NO: 561 - protein, 203 aa, Zea mays
  misc_feature: Ceres CLONE ID no.444113
  misc_feature: Bit score of 194.3 for HMM based on sequences of FIGURE 2.
  misc_feature: Functional Homolog Of Ceres SEEDLINE ID no. ME00045 at SEQ ID NO. 489
MSGRKNAGKVSPWLLVLICLGCFFVTYNLLTMPSRGRDGPRKFLGGGGDRHSTASLGSGSDSDPAKRFHVALTATDALYSQWQSRIMHYWYKEMRDRPGSDMGGFTRILHSGKPDGLMDEIPTMVVDPLPEGKDQGYIVLNRPWAFVQWIQKAKIVEEYILMAEPDHVFVKPLPNLSHGDEPAAFPFFYIKPTENEKILREFF

SEQ ID NO: 562 - protein, 154 aa, Oryza sativa subsp. indica
  misc_feature: Public GI ID no.125525355
  misc_feature: Bit score of 101.2 for HMM based on sequences of FIGURE 2.
  misc_feature: Functional Homolog Of Ceres SEEDLINE ID no. ME00045 at SEQ ID NO. 489
MAYFSMGYVVLNRPWAFVQWLEKAKIEEEYILMAEPDHIFVRPLPNLARDDPAAFPFFYITPSEHESVLRKYYPKERGPVTNIDPIGNSPVIIKKGVLTYGKIGEWRFDKRAYQDRPPPRNLTLPPPGVPESVVTLVKMVNEATANLPGWDDGR

SEQ ID NO: 563 - DNA, 1143 bp, Sorghum bicolor
  misc_feature: Ceres ANNOT ID no.6028854
  misc_feature: Encodes the peptide sequence at SEQ ID NO 564
atgaacgcggcggcggcggcggcgcggaaggccgcgggcggcggcatggcgcgcgcgccggcgctggtgctagcgctggtggcggcgggggcgttcctgatctcctacaacttcttcgccatgctgtttcgcggcggcggcggcggaataggcggcgcggcggcgtcctcggggacgagggaccctgtggtggccatgccggcgtggatgcgcgaggcggcggacaccgaggcgcggcggcggccgttccatgtggcgctcacggccacggacgcgccctacagccggtggcagtgccgagtcatgtacttctggtacaagcggatgcaggcgcggccgggcggggaggccatgggcggcttcacgcgcgtgctgcactcgggaaagcccgacgggctcatggacgagatccccaccttcgtcgtcgacccgctgcccgctggcaaggaccatggatacgtggtcttgaatagaccgtgggcatttgtgcagtggcttcagaaagcaaagattgaagaagagtatatactaatggcagaaccagatcatatatttgtgaaacctttaccaaatttggcccatgacgatgatccagcagcatttcccttcttttacattacaccatcagaacatgaacaaattatccggaaatactatgccaaagaaagaggtcctgtcacagatattgatcctattggaaattctcctgtaatcattaagaagacacttcttgagaagattgcccccacatggatgaatgtgtcaattcaaatgaaagaggatgaagagacagataaaatttttggatgggtgctggaaatgtatgcatacgctgttgctagcgcattgcatggggttcagcatatccttcgtaaagatttcatgatccagccaccctttgatacaaagctcgggaatacatttataatccacttcacttatggatgtgactattcactaaagggtgaactgacctatgggaaagttggtgaatggcgatttgacaaaagatcattcccagatgggccaccaccaagaaattttacattgccccctcctggagtcccagaaagtgtggttactctagtaaaaatggtcaatgaagctagtgcaaacctacctcggtgggatgatggaatataa

SEQ ID NO: 564 - protein, 380 aa, Sorghum bicolor
  misc_feature: Ceres ANNOT ID no.6028854
  misc_feature: Bit score of 897.1 for HMM based on sequences of FIGURE 2.
  misc_feature: Functional Homolog Of Ceres SEEDLINE ID no. ME00045 at SEQ ID NO. 489
MNAAAAAARKAAGGGMARAPALVLALVAAGAFLISYNFFAMLFRGGGGGIGGAAASSGTRDPVVAMPAWMREAADTEARRRPFHVALTATDAPYSRWQCRVMYFWYKRMQARPGGEAMGGFTRVLHSGKPDGLMDEIPTFVVDPLPAGKDHGYVVLNRPWAFVQWLQKAKIEEEYILMAEPDHIFVKPLPNLAHDDDPAAFPFFYITPSEHEQIIRKYYAKERGPVTDIDPIGNSPVIIKKTLLEKIAPTWMNVSIQMKEDEETDKIFGWVLEMYAYAVASALHGVQHILRKDFMIQPPFDTKLGNTFIIHFTYGCDYSLKGELTYGKVGEWRFDKRSFPDGPPPRNFTLPPPGVPESVVTLVKMVNEASANLPRWDDGI

SEQ ID NO: 565 - DNA, 795 bp, Sorghum bicolor
  misc_feature: Ceres ANNOT ID no.6115356
  misc_feature: Encodes the peptide sequence at SEQ ID NO 566
atgagcgggaggaagaatgcgggcaaggtttccccctggttgctcggcctcatctctttaggatgcttctttgtgacctacaacctcctgacgatgcacggccggggacgggatgggccgcgcaagttcctcggcggcggcgaggatcacgactcaacgggctccggttcggaccccgcgaagcggttccacgtcgcgcttacggcgacggacgcactgtacagtcagtggcagtcgcggataatgcactactggtacaaggagatgagggaccgacctggctctgacatgggtggcttcactaggatccttcactcggggaagcctgatggattgatggatgagatacccaccatggtggttgacccccttcctgaaggcaaggataagggatatattgtcttaaataggccttgggcgtttgtccagtggatccagagagcaaagatcgtagaagattatatactaatggcagagccagatcatgtctttgtgaagcctttgccaaacttagcgcatggtgatgaaccggcagcatttccgtttttctacatcaaaccaactgataatgagaagatattgaggaaattttttccagaagaaaaagggcctgtttcaaatattgatcctattggcaactctccagttataatcaagaaggctcagcttgagaagattgctccaacctggatgaatgtttcattaaaaatgaaagaggatcaggagacagacaaagcatttggatgggtcttggaaatgtcagtgctgagaagtcttgtcactagatacagatag

SEQ ID NO: 566 - protein, 264 aa, Sorghum bicolor
  misc_feature: Ceres ANNOT ID no.6115356
  misc_feature: Bit score of 450.2 for HMM based on sequences of FIGURE 2.
  misc_feature: Functional Homolog Of Ceres SEEDLINE ID no. ME00045 at SEQ ID NO. 489
MSGRKNAGKVSPWLLGLISLGCFFVTYNLLTMHGRGRDGPRKFLGGGEDHDSTGSGSDPAKRFHVALTATDALYSQWQSRIMHYWYKEMRDRPGSDMGGFTRILHSGKPDGLMDEIPTMVVDPLPEGKDKGYIVLNRPWAFVQWIQRAKIVEDYILMAEPDHVFVKPLPNLAHGDEPAAFPFFYIKPTDNEKILRKFFPEEKGPVSNIDPIGNSPVIIKKAQLEKIAPTWMNVSLKMKEDQETDKAFGWVLEMSVLRSLVTRYR

SEQ ID NO: 567 - DNA, 441 bp, Arabidopsis thaliana
  misc_feature: Ceres SEEDLINE ID no.ME02190
  misc_feature: Encodes the peptide sequence at SEQ ID NO. 568
gaagtaggaaaaaacaaaaccaaagaagatctaaagagataaagagaatgatgaagaagcaagtgacgatagtggcggctcttctgattatgatggctttatgttccagcttgaatatggtggccgaggctcaattaggccccggagactgctacgacggttgctccaccgcctgcgtccaacgtgacccgagaaagacgtcccgatgcgatcgcaagtgttccattcgttgtggtccagatgctgccagggcaagtgggagtggtgtttaaactttatattttaccaagatccatgcatttggatttaattatgttgtaatcttatttaataatcgtatctctggaaaacatattctgtaatttttatgtagttattggaaccaataaataataacagctacaatggtggaattaagtacactagtgctggtttgtaacc

SEQ ID NO: 568 - protein, 74 aa, Arabidopsis thaliana
  misc_feature: Ceres SEEDLINE ID no.ME02190
  misc_feature: Bit score of 196.9 for HMM based on sequences of FIGURE 3.
MMKKQVTIVAALLIMMALCSSLNMVAEAQLGPGDCYDGCSTACVQRDPRKTSRCDRKCSIRCGPDAARASGSGV

SEQ ID NO: 569 - protein, 74 aa, Arabidopsis thaliana
  misc_feature: Public GI ID no.79318519
  misc_feature: Bit score of 186.8 for HMM based on sequences of FIGURE 3.
  misc_feature: Functional Homolog Of Ceres SEEDLINE ID no. ME02190 at SEQ ID NO. 568
MMKKQVTIVAALLIMMALCSSLNMVAEAQLGPGDCYDGCSTACVQRDREKTSRCDRKCSIRCGPDAARASGSGV

SEQ ID NO: 570 - protein, 85 aa, Arabidopsis thaliana
  misc_feature: Public GI ID no.79318537
  misc_feature: Bit score of 184.4 for HMM based on sequences of FIGURE 3.
  misc_feature: Functional Homolog Of Ceres SEEDLINE ID no. ME02190 at SEQ ID NO. 568
MMKKQVTIVAALLIMMALCSSLNMVAEAQLGPGDCYDGCSTACVQRDPRKTSRCDRKCSIRCGPGKHYETGYVPTDAARASGSGV

SEQ ID NO: 571 - DNA, 400 bp, Brassica napus
  misc_feature: Ceres CLONE ID no.956998
  misc_feature: Encodes the peptide sequence at SEQ ID NO 572
agagaaaggaaaaaaaaaatcaaagatctaaacaatagaagaatgatgaagaagcaagtgacaatagtggcggctcttctgattctggtggctttatcttccaatttggatatggttgctgaggctcagttaggccctggagactgctacgacggttgctccaccgcctgcgtccagcgcgactcgagaaagacgtcccgatgcgatcgcaagtgctctattcggtgtggcccagatgctaaaaaggcaggagagactggtgcttaaactttgatatttactaagatccatattttggatttaataatgttgtaatcttcgtttcaaaattttatctctgcaaaacatattacgtattgtttatgttgttattgtagtcaataaccaataattgctgctc

SEQ ID NO: 572 - protein, 74 aa, Brassica napus
  misc_feature: Ceres CLONE ID no.956998
  misc_feature: Bit score of 201.1 for HMM based on sequences of FIGURE 3.
  misc_feature: Functional Homolog Of Ceres SEEDLINE ID no. ME02190 at SEQ ID NO. 568
MMKKQVTIVAALLILVALSSNLDMVAEAQLGPGDCYDGCSTACVQRDSRKTSRCDRKCSIRCGPDAKKAGETGA

SEQ ID NO: 573 - DNA, 532 bp, Brassica napus
  misc_feature: Ceres CLONE ID no.978154
  misc_feature: Encodes the peptide sequence at SEQ ID NO 574
gaaaggaaaaaaaaaatcaaagatctaaacaatagaagaatgatgaagaagcaagtgacaatagtggcggctcttctgattctggtggctttatcttccaatttggatatggttgctgaggctcagttaggccctggagactgctacgacggttgctccaccgcctgcgtccagcgcgactcgagaaagacgtcccgatgcgatcgcaagtgctctattcggtgtggcccaggtaattaatgaaccggatccttatatctggtacatttgtataatcggtaacaactctaactggtcggttagctttgtatgttatcatgcatgaaacagactaacagggtcggaatttatgatctatgatctatcatacttaaagcctattagaatcagatcatacgtcgtgagatgacttggtttagcatctgagtgaaaccaaaaaaggacttgaaactttttttttttttttgtaattgcagatgctaaaaaggcaggararactggtgcttaaactttgatatttactaagatccat

SEQ ID NO: 574 - protein, 66 aa, Brassica napus
  misc_feature: Ceres CLONE ID no.978154
  misc_feature: Bit score of 167.5 for HMM based on sequences of FIGURE 3.
  misc_feature: Functional Homolog Of Ceres SEEDLINE ID no. ME02190 at SEQ ID NO. 568
MMKKQVTIVAALLILVALSSNLDMVAEAQLGPGDCYDGCSTACVQRDSRKTSRCDRKCSIRCGPGN

SEQ ID NO: 575 - DNA, 459 bp, Brassica napus
  misc_feature: Ceres CLONE ID no.1035628
  misc_feature: Encodes the peptide sequence at SEQ ID NO 576
gagagagaaagagaaagaaaccagaaacaataacaaagaagatctaaagaaaaataagaatgatgaaaaagcaagtgacaatagtggcggctcttctgatcataatggctttttctttcaacttagatatggttgcggaggctcagttaggccccggagactgctacgatggttgctccacaggctgcgtccagcgcgactcgagaaagatggcccgatgcgatcgcaagtgctccattcggtgcggcccagatgctaaaaaggcaagaaagactggtgcataaatctttatatccacgatgatccaattagattcaatgatgttgtaatctccgtttcataactgtatcgcttcaaaacatatttcctattgtgtgttgttatcgtaatcagtcaataaggcaatacagctacaatgcttgatttcacttctagtacaataatgtattaacaactttg

SEQ ID NO: 576 - protein, 74 aa, Brassica napus
  misc_feature: Ceres CLONE ID no.1035628
  misc_feature: Bit score of 182.4 for HMM based on sequences of FIGURE 3.
  misc_feature: Functional Homolog Of Ceres SEEDLINE ID no. ME02190 at SEQ ID NO. 568
MMKKQVTIVAALLIIMAFSFNLDMVAEAQLGPGDCYDGCSTGCVQRDSRKMARCDRKCSIRCGPDAKKARKTGA

SEQ ID NO: 577 - DNA, 479 bp, Glycine max
  misc_feature: Ceres CLONE ID no.695006
  misc_feature: Encodes the peptide sequence at SEQ ID NO 578
agtgttttacgagtaagttaagataagatgaagaagatggtggttgcaatgatgcttatatttcttctaatttctacgcaaatggagagcgttgagcccgatgctgcagattgcttggatggttgcactactgcctgtgttcaaagcgactcgaggcttcaagcacggtgtgatcgcaagtgcagcattagatgcggtccagattccacaatcaaggaggacatgggttgagtatgtaaagtcacagcgcaagcaagcagtgtctgcttgaccaacaccgtgtcttttttagtccttgcttatatatgatataacattttaaagtcttcccgatgctgtagtagcatccaaataaacatggatgatagacagctttttaagatcaaatttgttagggtagatgctttgtaacttgaaggaatgtgatatgaatgaatgtttcattatggcaataaatacatcactgccaatgtgactat

SEQ ID NO: 578 - protein, 67 aa, Glycine max
  misc_feature: Ceres CLONE ID no.695006
  misc_feature: Bit score of 177.9 for HMM based on sequences of FIGURE 3.
  misc_feature: Functional Homolog Of Ceres SEEDLINE ID no. ME02190 at SEQ ID NO. 568
MKKMVVAMMLIFLLISTQMESVEPDAADCLDGCTTACVQSDSRLQARCDRKCSIRCGPDSTIKEDMG

SEQ ID NO: 579 - DNA, 493 bp, Glycine max
  misc_feature: Ceres CLONE ID no.464169
  misc_feature: Encodes the peptide sequence at SEQ ID NO 580
gactagtgaaaaaggatacagaagagaagggaaagttaagatgaagaagatggtggctgcaatgatgctttttcttctcatttctacgcaaatgaagagcgttgagccggatgctgcggattgcttggatggttgcagtactgcctgtgttcaaagcgactcgaggcttcaagcacggtgtgaacgcaaatgcagcattagatgcggtccagattccacaatcaaggaggacatgagttgatttgagtatgtaaagtcacagcgcaagcaagcagtgtttcatcaccatagtcttatttagtccttgcttatacatataataacattttaaggtttgtctgatgttgtagtaacatctaaataaacatggatggctttttaagatcaaattggttagggtagatgttgcgacttgaaggaatgctagctgatgtgaatgagtgttttatcaaggcaataaatacatcaccaattaatatcactatacatttgc

SEQ ID NO: 580 - protein, 66 aa, Glycine max
  misc_feature: Ceres CLONE ID no.464169
  misc_feature: Bit score of 151.2 for HMM based on sequences of FIGURE 3.
  misc_feature: Functional Homolog Of Ceres SEEDLINE ID no. ME02190 at SEQ ID NO. 568
MKKMVAAMMLFLLISTQMKSVEPDAADCLDGCSTACVQSDSRLQARCERKCSIRCGPDSTIKEDMS

SEQ ID NO: 581 - DNA, 459 bp, Populus balsamifera subsp. trichocarpa
  misc_feature: Ceres ANNOT ID no.1474075
  misc_feature: Encodes the peptide sequence at SEQ ID NO 582
atgatgaggaaagtattggttgcagtgttgattgtgagcatggtcgcttctcattttgagaacgtagcgtctgatgcttctgattgcatggacgcatgtaccaccggctgcgttcaatcaaacacaagacttacgagccgctgtgatatcaaatgtgggataagatgcggtccagattctgaagtcgaagatcacacagaaaggagagaatcacttctgaaacttcagctgctaaaaacacagattcatctatcaagctataaggcaccagtaaagtacacactgcaatctgcatcgtggaacaagcaattaaaggaaatcatgataaacgaagtggaagaggagagaggccatattgtcatcttctggaacgaagaaccagaagaaattcctcagaatcctaaaacatcaaaacagcaaataacctccatggaggagacaatttcattagccagttaa

SEQ ID NO: 582 - protein, 152 aa, Populus balsamifera subsp. trichocarpa
  misc_feature: Ceres ANNOT ID no.1474075
  misc_feature: Bit score of 168.4 for HMM based on sequences of FIGURE 3.
  misc_feature: Functional Homolog Of Ceres SEEDLINE ID no. ME02190 at SEQ ID NO. 568
MMRKVLVAVLIVSMVASHFENVASDASDCMDACTTGCVQSNTRLTSRCDIKCGIRCGPDSEVEDHTERRESLLKLQLLKTQIHLSSYKAPVKYTLQSASWNKQLKEIMINEVEEERGHIVIFWNEEPEEIPQNPKTSKQQITSMEETISLAS

SEQ ID NO: 583 - DNA, 201 bp, Populus balsamifera subsp. trichocarpa
  misc_feature: Ceres ANNOT ID no.1527488
  misc_feature: Encodes the peptide sequence at SEQ ID NO 584
atgaggaaagtattggttgcagtgttgattgtgagcatggtcgcttctcattttgagaacgtagcgtctgatgcttctgattgcatggacgcatgtaccaccggctgcgttcaatcaaacacaagacttacgagccgctgtgatatcaaatgtgggataagatgcggtccagattctgaagtcgaagatcacacaggttaa

SEQ ID NO: 584 - protein, 66 aa, Populus balsamifera subsp. trichocarpa
  misc_feature: Ceres ANNOT ID no.1527488
  misc_feature: Bit score of 172.6 for HMM based on sequences of FIGURE 3.
  misc_feature: Functional Homolog Of Ceres SEEDLINE ID no. ME02190 at SEQ ID NO. 568
MRKVLVAVLIVSMVASHFENVASDASDCMDACTTGCVQSNTRLTSRCDIKCGIRCGPDSEVEDHTG

SEQ ID NO: 585 - DNA, 267 bp, Populus balsamifera subsp. trichocarpa
  misc_feature: Ceres ANNOT ID no.1474073
  misc_feature: Encodes the peptide sequence at SEQ ID NO 586
atgatgaggaaaatattggttgctgtgttgattgtgagcatggtcgcttctcattttgagaacgtagcgtctgatgcttctgattgcaatgacgcatgtaccaccggctgcgttcaatcaaacacgagacttatgcgccgctgtgagatcaaatgtgggataagatgcggtccagattctgaagtcgaagatcacacagtgttgatattctttgtattagaagtaagaagggaagggggaattagggctatcaaatctcaaatttga

SEQ ID NO: 586 - protein, 88 aa, Populus balsamifera subsp. trichocarpa
  misc_feature: Ceres ANNOT ID no.1474073
  misc_feature: Bit score of 151.3 for HMM based on sequences of FIGURE 3.
  misc_feature: Functional Homolog Of Ceres SEEDLINE ID no. ME02190 at SEQ ID NO. 568
MMRKILVAVLIVSMVASHFENVASDASDCNDACTTGCVQSNTRLMRRCEIKCGIRCGPDSEVEDHTVLIFFVLEVRREGGIRAIKSQI

SEQ ID NO: 587 - DNA, 201 bp, Populus balsamifera subsp. trichocarpa
  misc_feature: Ceres ANNOT ID no.1527486
  misc_feature: Encodes the peptide sequence at SEQ ID NO 588
atgaggaaaatattggttgctgtgttgattgtgagcatggtcgcttctcattttgagaacgtagcgtctgatgcttctgattgcaatgacgcatgtaccaccggctgcgttcaatcaaacacgagacttatgcgccgctgtgagatcaaatgtgggataagatgcggtccagattctgaagtcgaagatcacacaggttaa

SEQ ID NO: 588 - protein, 66 aa, Populus balsamifera subsp. trichocarpa
  misc_feature: Ceres ANNOT ID no.1527486
  misc_feature: Bit score of 152.9 for HMM based on sequences of FIGURE 3.
  misc_feature: Functional Homolog Of Ceres SEEDLINE ID no. ME02190 at SEQ ID NO. 568
MRKILVAVLIVSMVASHFENVASDASDCNDACTTGCVQSNTRLMRRCEIKCGIRCGPDSEVEDHTG

SEQ ID NO: 589 - DNA, 1273 bp, Arabidopsis thaliana
  misc_feature: Ceres SEEDLINE ID no.ME02549
  misc_feature: Encodes the peptide sequence at SEQ ID NO. 590
accaacacacaaagattccattacaaataaacaattttcatatatatctataacaaaaaaaaacaatggcgacctcaagcatgaagagcattccaatggcgatcccaagtttctccatgtgtcacaagctcgagctccttaaagaaggcaaaactcgcgacgtcccgaaagccgaagaagatgaagggctaagctgcgagttccaagagatgttggattctcttcctaaggagagaggatggagaactcgttacctttacctattccaagggttttggtgccaagccaaagagattcaagccatcatgtctttccaaaaacatttccaatccctcgaaaacgacgtcgttctcgccaccatacctaaatccggtacaacctggctaaaagctttaactttcaccatccttaaccgtcaccggtttgatccggttgcctcgagtaccaaccaccctcttttcacttccaaccctcatgaccttgtacctttcttcgagtacaagctttacgccaacggagatgttcccgatctctcgggtctagccagtccaagaacgttcgcaacccacttaccgttcggttccttaaaggaaacgatcgagaaacccggtgtgaaggtcgtgtacttgtgccggaacccgtttgacacattcatctcttcgtggcattacaccaacaacatcaaatccgagtcagtgagcccagtcttgctagaccaagcttttgatctgtattgccggggagtgatcgggtttggcccgttttgggaacacatgttgggatactggagagagagcttgaagagaccagagaaagtcttctttttaaggtacgaggatctcaaagacgacatcgagaccaacttgaagaggcttgcaactttcttagagcttcctttcaccgaagaagaggaacgaaagggagttgtgaaggctatcgccgagctgtgtagcttcgagaatctgaagaagttggaggtgaacaagtcaaacaagtcgatcaagaactttgagaatcgattcttgtttcggaaaggagaagtgagtgattgggttaactatttgtcaccttcacaagtggaaagattgtcagccttagtggatgacaagttaggtggatctggtctcactttcaggttgagctaaatataaggccacgtgcccccatttctactcttgttctgagggcctactatatacgttaagctaagttaaggcagttgtattgttgttacagatagacatcgaagcaacgtaacgtccataattaagtc

SEQ ID NO: 590 - protein, 359 aa, Arabidopsis thaliana
  misc_feature: Ceres SEEDLINE ID no.ME02549
  misc_feature: Bit score of 938.6 for HMM based on sequences of FIGURE 4.
  misc_feature (91)..(353): Pfam Name: Sulfotransfer_1 Pfam Description: Sulfotransferase domain
MATSSMKSIPMAIPSFSMCHKLELLKEGKTRDVPKAEEDEGLSCEFQEMLDSLPKERGWRTRYLYLFQGFWCQAKEIQAIMSFQKHFQSLENDVVLATIPKSGTTWLKALTFTILNRHRFDPVASSTNHPLFTSNPHDLVPFFEYKLYANGDVPDLSGLASPRTFATHLPFGSLKETIEKPGVKVVYLCRNPFDTFISSWHYTNNIKSESVSPVLLDQAFDLYCRGVIGFGPFWEHMLGYWRESLKRPEKVFFLRYEDLKDDIETNLKRLATFLELPFTEEEERKGVVKAIAELCSFENLKKLEVNKSNKSIKNFENRFLFRKGEVSDWVNYLSPSQVERLSALVDDKLGGSGLTFRLS

SEQ ID NO: 591 - protein, 333 aa, Vitis vinifera
  misc_feature: Public GI ID no.147822456
  misc_feature: Bit score of 704.9 for HMM based on sequences of FIGURE 4.
  misc_feature (68)..(327): Pfam Name: Sulfotransfer_1 Pfam Description: Sulfotransferase domain
  misc_feature: Functional Homolog Of Ceres SEEDLINE ID no. ME02549 at SEQ ID NO. 590
MGRTQFPKSQSAAEDAEELSHECKELLLSLPKERGWRTPHIYLYQGFWCQPKEIQAITNFQHHFQARDTDLILATMPKAGTTWLKAMAFAILNRKPIPVSTTHPLHTSNPHDLVPFLEYKLYANNNFPDLSKLPQPRLFATHVPFASLPESITKSNSRVVYMCRNPLDAFASSWHFLMKARPESLGPISIEEGFQMYCKGSMAFGPFWKHMLGYWKESIERPHKVLFLKYEDTKEDIIFQLKRLAKFLGVPFSLEEERKGVIEEIARLCSFENLKNLEVNQSGKSIGYFENKDLFRKGVVGDWVNLLTPLMAKQLVQVMEEKLEGSDLSFKVF

SEQ ID NO: 592 - protein, 333 aa, Medicago truncatula
  misc_feature: Public GI ID no.144923935
  misc_feature: Bit score of 736.8 for HMM based on sequences of FIGURE 4.
  misc_feature (60)..(326): Pfam Name: Sulfotransfer_1 Pfam Description: Sulfotransferase domain
  misc_feature: Functional Homolog Of Ceres SEEDLINE ID no. ME02549 at SEQ ID NO. 590
MASTYNTENKVIHDYNNLILSLPRENGCETEYMYFFHGFWCPSYLIQSVNTFQNKFHAKDNDIVVASMPKSGTTWLKGLAYAIVNRQHFTSLENNNHPLLLFNPHELVPLFEVNLYGGKDILLPQIDVSNMIEPRLFGTHIPFLSLPKSVKESSCKIIYICRNPFDTFVSYWNYINKVRSKKSLTELTLEESFERYCKGICLFGPFWDNMLGYLKESIERPHKVLFLKYEDLKEDVNFHIKRIAEFVGFPFTQEEENNGVVENIIKLCSFESMKESKGNQSETVSTIYEKKFFFRKGEIGDWVNYFSPSMIERLSKVIEEKLSGSNLSFKGGP

SEQ ID NO: 593 - protein, 347 aa, Medicago truncatula
  misc_feature: Public GI ID no.140038730
  misc_feature: Bit score of 803.5 for HMM based on sequences of FIGURE 4.
  misc_feature (76)..(340): Pfam Name: Sulfotransfer_1 Pfam Description: Sulfotransferase domain
  misc_feature: Functional Homolog Of Ceres SEEDLINE ID no. ME02549 at SEQ ID NO. 590
MASTDLTNMKEDQSRDGQETISEENKVIHDYNNLILSLPRENGCDTQYFYFYHGFWCPSTLIQSVNSFQNNFHAKDSDIVVASMPKSGTTWLKGLAYAIVNRQHFTSLENNHPLLSFNPHELVPHFEVSGNNTDGQMPQIDVPNMVEPRLYGTHMPFPSLPKSIQESNCKIIYICRNPFDTFVSYWTFINKLRLKKSLTELTLEESFERYCKGICFFGPFWDNMLGYLKESIERPDRVLFLKYEDLKEDVNFHTKRIAEFVGFPFTEEEENNGVIENIIKLCSFESMKESSENKSGTAALKIEREFFFRKGEIGDWVNYLSPSMIKKLSKVMEEKLSGSSLSFKGCP

SEQ ID NO: 594 - protein, 367 aa, Oryza sativa subsp. japonica
  misc_feature: Public GI ID no.78708014
  misc_feature: Bit score of 317.5 for HMM based on sequences of FIGURE 4.
  misc_feature (93)..(363): Pfam Name: Sulfotransfer_1 Pfam Description: Sulfotransferase domain
  misc_feature: Functional Homolog Of Ceres SEEDLINE ID no. ME02549 at SEQ ID NO. 590
MPLVSAAAGCQRGPVPFKDVAAVVAGDDGAAAAMAHRPLADPEDEDHDELIATLPCKPPTPLMRRMRLYRGGWFPEKWLPAIMAFRRRFEARDGDVVVASLPKCGTTWLKALAFATAVRGTYPPPPVAGSDDEGNRRHPLLRLNPHECVPFLESVYSTMEEESKLDATPSPRLLSTHLPYSVLPASITDSSRCKIIYVCRQPKDMLISFWHFINRDKSRDVSSSYVWESVRECTYFGSPIWDHILGYWNASKVKPDNVLILKYEDMKRNPTENVEKIAEFIGQPFSNSEKEASIVDNIVELCSFEKMKALGASMAGSQKVISSEFPNDSFFRKGAIGDWVNHVTPEMAESLDKFLSEKFDGSGFTFM

SEQ ID NO: 595 - protein, 334 aa, Oryza sativa subsp. japonica
  misc_feature: Public GI ID no.115481362
  misc_feature: Bit score of 317.5 for HMM based on sequences of FIGURE 4.
  misc_feature (60)..(330): Pfam Name: Sulfotransfer_1 Pfam Description: Sulfotransferase domain
  misc_feature: Functional Homolog Of Ceres SEEDLINE ID no. ME02549 at SEQ ID NO. 590
MAHRPLADPEDEDHDELIATLPCKPPTPLMRRMRLYRGGWFPEKWLPAIMAFRRRFEARDGDVVVASLPKCGTTWLKALAFATAVRGTYPPPPVAGSDDEGNRRHPLLRLNPHECVPFLESVYSTMEEESKLDATPSPRLLSTHLPYSVLPASITDSSRCKIIYVCRQPKDMLISFWHFINRDKSRDVSSSYVWESVRECTYFGSPIWDHILGYWNASKVKPDNVLILKYEDMKRNPTENVEKIAEFIGQPFSNSEKEASIVDNIVELCSFEKMKALGASMAGSQKVISSEFPNDSFFRKGAIGDWVNHVTPEMAESLDKFLSEKFDGSGFTFM

SEQ ID NO: 596 - protein, 334 aa, Oryza sativa subsp. indica
  misc_feature: Public GI ID no.125531350
  misc_feature: Bit score of 316.7 for HMM based on sequences of FIGURE 4.
  misc_feature (60)..(330): Pfam Name: Sulfotransfer_1 Pfam Description: Sulfotransferase domain
  misc_feature: Functional Homolog Of Ceres SEEDLINE ID no. ME02549 at SEQ ID NO. 590
MAHRPLADPEDEDHDELIATLPCKPPTPLMRRMRLYRGGWFPEKWLPAIMAFRRRFEARDGDVVVASLPKCGTTWLKALAFATAARGTYPPPPVAGGDDEGNRRHPLLRLNPHECVPFLESVYSTMEEESKLDATPSPRLLSTHLPYSVLPASITDSSRCKIIYVCRQPKDMLISFWHFINRDKSRDVSSSYVWESVRECTYFGSPIWDHILGYWNVSKVKPDNVLILKYEDMKRNPTENVEKIAEFIGQPFSNSEKEASIVDNIVELCSFEKMKALGASMAGSQKVISSEFPNDSFFRKGAIGDWVNHVTPEMAESLDKLLSEKFDGSGFTFM

SEQ ID NO: 597 - protein, 346 aa, Oryza sativa subsp. indica
  misc_feature: Public GI ID no.125525598
  misc_feature: Bit score of 397.5 for HMM based on sequences of FIGURE 4.
  misc_feature (71)..(337): Pfam Name: Sulfotransfer_1 Pfam Description: Sulfotransferase domain
  misc_feature: Functional Homolog Of Ceres SEEDLINE ID no. ME02549 at SEQ ID NO. 590
MASPPSLLPSAGEDDESQREVFEQLRQLVSTYPTVPSGLDTPYYRHPDGWYTFLPAMVSVMVAQRHFTARDTDIIIATFPKCGTTWLKALLFATVHRDGGGAGGVEDDAALAQLRARNPHQLVPFLEIQVYVRDRAPDLSSLPAPRLLATHIPRPSLPASVAISGCKVVYMCRDPKDCLVSLWHFLDAQRREPRGDVGEDFRLFCDGVSLVGPYWDHVLAYWRWHVERPGQVLFMTYEELSGDTLGQLRRLAEFVGRPFTGEERAARVDEAIVKACSFESLAGAEVNRSGTIELMEEPMRNAEFFRRGVVGGWPNYLSPEMATRIDEITESKFRGSGLVLPTMMTM

SEQ ID NO: 598 - protein, 338 aa, Oryza sativa subsp. japonica
  misc_feature: Public GI ID no.77548630
  misc_feature: Bit score of 344.2 for HMM based on sequences of FIGURE 4.
  misc_feature (74)..(325): Pfam Name: Sulfotransfer_1 Pfam Description: Sulfotransferase domain
  misc_feature: Functional Homolog Of Ceres SEEDLINE ID no. ME02549 at SEQ ID NO. 590
MAPSFPLSFAPQSADEATAHKEIYDQLRQAVETFPTAPNSSTSFTYSRHPDGWYTFPEGVVSAMVIKSHLTARTTDIFMVTFPKSGTTWLKALLHSALHRRADDLAAHSPHQLVPFLETQVFIKDRIPDLSSLPAPRLLMTHIPSQSLPDSVADSSCKVVYLCRDPKDCFISLWHFLNRFRPWDINEAHRNFCDGVSLFGPYWEHVLGYWRWHVKRPSQVLFLTYEELTTDTLGQLRRLAEFVGRPFMVKEQEIEVDRKIVEACAMESLSRLEVNQSGTTDMVDKTYANNIFFRRGVVGDWRNHLTPEMARRIDEITEIKFKGSGLLLHPQFLQAKRE

SEQ ID NO: 599 - protein, 346 aa, Oryza sativa subsp. japonica
  misc_feature: Public GI ID no.46798895
  misc_feature: Bit score of 400.2 for HMM based on sequences of FIGURE 4.
  misc_feature (71)..(337): Pfam Name: Sulfotransfer_1 Pfam Description: Sulfotransferase domain
  misc_feature: Functional Homolog Of Ceres SEEDLINE ID no. ME02549 at SEQ ID NO. 590
MASPPSLLPSAGDDDESQREVYEQLRQLVSTYPTVPSGLDTPYYRHPDGWYTFLPAMVSVMVAQRHFTARDTDIIIATFPKCGTTWLKALLFATVHRDGGGAGGVEDDAALAQLRARNPHQLVPFLEIQVYVRDRAPDLSSLPAPRLLATHIPRPSLPASVAISGCKVVYMCRDPKDCLVSLWHFLDAQRPEPRGDVGEDFRLFCDGVSLVGPYWDHVLAYWRWHVERPGQVLFMTYEELSGDTLGQLRRLAEFVGRPFTGEERAARVDEAIVKACSFESLAGAEVNRSGTIELMEEPMRNAEFFRRGVVGGWPNYLSPEMATRIDEITESKFRGSGLVLPTMMTM

SEQ ID NO: 600 - protein, 391 aa, Oryza sativa subsp. indica
  misc_feature: Public GI ID no.125564653
  misc_feature: Bit score of 299.8 for HMM based on sequences of FIGURE 4.
  misc_feature (90)..(361): Pfam Name: Sulfotransfer_1 Pfam Description: Sulfotransferase domain
  misc_feature: Functional Homolog Of Ceres SEEDLINE ID no. ME02549 at SEQ ID NO. 590
MVAAAAAAAEAKAAIGVATPTPTAAPCGSTTTPRDADVDDKMTIVGHPAASLPLETRWPPFPLRRLGGFWMPESLLPAVAALHTSFAPAPDGVLLASFPKSGTSWLKALAFAAANRAAHPPSDADHPLRRRNPHDCVEFFEMRPDEHTGATSDGIAVDAASPPPPPRVLATHLPYSLLPKRITAGDGCRIIYICRDPKDTLVSFWHFSKKMAATMAVDAGAFTFDEAFELFCDGNCTGGPQWRHVLEYWEASRRCPGKVLFLRYEDMLRRPASGLRKMAEFMGCPFAAAEEAAGVADAIVELCSLDELRSLEVNRNGTDVLGLKNESYFREGVAGDWRNHMTPAMAARLDKIVNDATRGSGLSLANATPSPPMHENEIKGNLTIYHSQNDI

SEQ ID NO: 601 - DNA, 1372 bp, Zea mays
  misc_feature: Ceres CLONE ID no.998865
  misc_feature: Encodes the peptide sequence at SEQ ID NO 602
acgcgaccagtttgccggcaccaacacggcctgctgctccgcattttgatgactatttctgtctgaaaactgtctctgtcagttgttcattcaggctgctgcagcaagcaactggatgatggcttccaggcagtcagggaacaatgcacaagaagcagcatcaccattggcgagtcctcctcactccaacatagccagcatcatcccttcgctgcccctcgagaccaggtgcccaccgttccctctccgccggtatgccaacttttgggtgcctgaggtaatattgaaggcagaccaccccggcattcattcctgcttcaagccgagacccaccgacgtgttcgtcgcaagcttccccaagtctggcaccacttggctcaaggccctcgccttcgcgacgctgaagcgttccatgcatccgccattggatggcgaccatccactgcgtcgttgcaaccctcatgactgtgtcaggttcctcgatgctaatttcaaccagcagaaggatgagttcgaggctctcccgtccccgcgcgtgctagccacgcacctcccctactccctgctgcccggtagcatcaccggggatccggatagggagcgctcggggtgccggatcgtgtatgtctgccgggaacccaaggacgctctggtctctgcttggctgttcacgaggaaggcggcgtcggcggtggggtctgacgctcgatcgttcacgatccaggaggccttggagcttttctgtgatggtcgctgtgtgtgcggccggcagtgggagcacgtcctccagtactgggaggagagcgtgaggaggcctgacagggtgctgttccttcggtatgaggagatgctgattgatcccgaggcacacgtcaggaagctcgccaagttcatggggtgtggattttctgaggaggaggaggagcacggggtggtgagcgccatcgtggagctgtgtagcctgggcaagatgagggacatggaggtgaacagaaatggaagcaatatgttgggggtcaagaacgaaagctacttcaggaagggagttgctggggactggagcaaccatatgacgccggacatggcgcagaggctagacaaggtcgtagaggatgcattgcaagggactggattcagctttacgagcacagcatgatcgatgaggcagtgtgctcatagtacttgcgaactgcagaataatgcttgctggttgcagatcataccagccagccatggtgaccacccttcttttgtgatgaaggggaaattgatttgcgtataattcatctgtataactttgttacaaaccatagtttgtggcaccttggcgcgccaaaaccatatgcattactgtgtaaaaaaaaaaaaaaaa

SEQ ID NO: 602 - protein, 346 aa, Zea mays
  misc_feature: Ceres CLONE ID no.998865
  misc_feature: Bit score of 340.8 for HMM based on sequences of FIGURE 4.
  misc_feature (72)..(339): Pfam Name: Sulfotransfer_1 Pfam Description: Sulfotransferase domain
  misc_feature: Functional Homolog Of Ceres SEEDLINE ID no. ME02549 at SEQ ID NO. 590
MMASRQSGNNAQEAASPLASPPHSNIASIIPSLPLETRCPPFPLRRYANFWVPEVILKADHPGIHSCFKPRPTDVFVASFPKSGTTWLKALAFATLKRSMHPPLDGDHPLRRCNPHDCVRFLDANFNQQKDEFEALPSPRVLATHLPYSLLPGSITGDPDRERSGCRIVYVCREPKDALVSAWLFTRKAASAVGSDARSFTIQEALELFCDGRCVCGRQWEHVLQYWEESVRRPDRVLFLRYEEMLIDPEAHVRKLAKFMGCGFSEEEEEHGVVSAIVELCSLGKMRDMEVNRNGSNMLGVKNESYFRKGVAGDWSNHMTPDMAQRLDKVVEDALQGTGFSFTSTA

SEQ ID NO: 603 - protein, 338 aa, Oryza sativa subsp. indica
  misc_feature: Public GI ID no.125556140
  misc_feature: Bit score of 476.6 for HMM based on sequences of FIGURE 4.
  misc_feature (78)..(330): Pfam Name: Sulfotransfer_1 Pfam Description: Sulfotransferase domain
  misc_feature: Functional Homolog Of Ceres SEEDLINE ID no. ME02549 at SEQ ID NO. 590
MYSSSSMKPSSPSQANQDADDAKTYKELYQRCTDLVSSWPSRQGLSYLQLFRHEKGWYNGVTPLVGTMVADELFAARPSDIVVATLPKSGTTWIKALLYATVHRREHPADAAGDHPFNSLSPHECVKFLEYQLYRADEAPDLDALPDPRLFATHAPFDLLPRAVVAAAPPSGCKFVNEYKSRNGRELVAVDAAVGFFCDGVSPFGPYWEHVLGYWCAHRERPERVLFLRYEEMKRDPAGHVRRLAEFAGVPFTSPEEDGGAVDAIVRLCSFDNMVGLEATKGGRTQLTTTTVPNSAFFRRGEVGDWANHLSPEMAQRIDAITEAKFAGFGLAPSLIEL

SEQ ID NO: 604 - protein, 374 aa, Oryza sativa subsp. indica
  misc_feature: Public GI ID no.125534482
  misc_feature: Bit score of 323.3 for HMM based on sequences of FIGURE 4.
  misc_feature (63)..(363): Pfam Name: Sulfotransfer_1 Pfam Description: Sulfotransferase domain
  misc_feature: Functional Homolog Of Ceres SEEDLINE ID no. ME02549 at SEQ ID NO. 590
MAPTSSVHREGGSAAMDMAELIPTLPLETGSPPFPLRQYGGYWLPEWVLPGLEAVHTRFEPRPSDVFLASFPKSGTTWLKALAFATINRTTYPPSGDAHPLRHRGPHDCVKFFESTFAISGEGGGGDVDVFAALPSPRAVARPGTCSPPSRRRARLLATHIPYSLLPERITSAAADDGDSGCRIVYVCRDPKDAFVSMWLFTMSNMVKGVTTTSDEHHPAAAAPSIEQVFDLFCDGRSIAGPQWHHVREYWEASRRRPEKVLFLRYEEMLREPARNVERLAEFLRCPFTAGEVAAGVVDAIVDLCSIDRLRNVQANKTGVTDLAVKKESFFRRGVAGDWSNHMSPEMASRLDRVVEDALRGSGFTFAAAAGDSE

SEQ ID NO: 605 - protein, 356 aa, Oryza sativa subsp. indica
  misc_feature: Public GI ID no.125550135
  misc_feature: Bit score of 292.4 for HMM based on sequences of FIGURE 4.
  misc_feature (83)..(349): Pfam Name: Sulfotransfer_1 Pfam Description: Sulfotransferase domain
  misc_feature: Functional Homolog Of Ceres SEEDLINE ID no. ME02549 at SEQ ID NO. 590
MSSTTGAGQSAGPGPVPFKDIVVDDDAAAAGGVQVQQPVAEEYHDIIATLPCRPSMHEYQGTWILDDWLPGRMAFRRRFEARAGDVVLASLPKCGTTWLKALAFATAARDRYDPSSSGGGERRHPLRRLNPHECVPFVEVVYNAGEEAKLDAAPSPRIISTHAPYSLLPASITQSSTCKIIYISREPKDMLISLWHFINKRCKPNIIPFSDIWNSIYNDAYPESPIREHILGYWNMSKIQSDRVLFLKYEDVLRDPIKNVEKIAEFIGQPFSDAEKEAGIIESIVKLCSLENLKALATNSTGNYQRLMKEVPSESFFRKGVVGDWANYVTPDMAERMDKFLAEKFHGSGFSFTECL

SEQ ID NO: 606 - DNA, 1403 bp, Triticum aestivum
  misc_feature: Ceres CLONE ID no.639816
  misc_feature: Encodes the peptide sequence at SEQ ID NO 607
atcaattattgtatccaaacagatctagaagagaagctgatcttctccttccttcggcaccctctccttccctgatccacctactactccttctctcttcctcctagatcctgatcgggtacgttacagacgcgctggccatggcttcccctcgccatcgccaggacggagacggaccacacgacggcgcgccgacgtacgccggcatgscgaagctggtgccggcgctcccgctcgagacgcggtgccssccgttcgcgctgcggcgctacggcggcttctggctgccggaggcggccctgcggcgcggcctcccggcgttgcacgccgggttcgcgcccaggcgcgcagacgtgctcctcgccagctaccccaagtccggcaccacctggctcaaggccctcgccttcgccaccgtccgccgcgccgtgcacccgccttcttccatcgaccacccgctccgccgtcgcaacccgcaggactgcgtcccgttcctcgagttcgacttcgaccacggggacatggccgagctcgaggcgctcccttcccsscgggtgctcgccacgcacctcccctactcgctcctccccgaccgcgtcgtcgccgacgacggcgcgcggatcgtgtacgtctgccgggaccccaaggacgcgctggtctcctcgtggctcttcaccaggaaagcgtcgccgagtgtcggagtggactccgactcctactcgctgcaggaggcggccgagcttttccgcgagggccggtgcttctacggccctcagtgccggcacgtgctcgagtactgggacgcgagccgccgtcccttcggcggcggcgaggtgctgttcctgaggtacgaggagatgctgcgcgacccggcggggagtctgaagacgatggcggagttcatgggatgcggcttctccgaggaggaggtggcgcgaggggtggtggacgagatcgtggacctgtgcagcctggagaagctgaagaacatggaggccaacagggacgggcggcggaacgcgtcgggcatcaggagcgactctttcttccggaagggggtcgccggggactggagcagccacatgtcgccggagatggggaagatgctggacgaggccgtcgaggaggcactccaggggtctgggttcagcttctctggctgagctccggcgagcactggccagggcggtagtgcggggcaaacaacaatgtcattgcaaagcacggcttggaacacatgttttgtggcgatccatggatttaaggcgcgagtttgattccagtttcttgctcgaaagttgattgtcttgtaagttcaaacagtagtttgataactcattccaaatgtttctttcccaaagttccgaatcattccagttctacaatttcagtcctcattcagc

SEQ ID NO: 607 - protein, 340 aa, Triticum aestivum
  misc_feature: Ceres CLONE ID no.639816
  misc_feature: Bit score of 312.6 for HMM based on sequences of FIGURE 4.
  misc_feature (69)..(335): Pfam Name: Sulfotransfer_1 Pfam Description: Sulfotransferase domain
  misc_feature: Functional Homolog Of Ceres SEEDLINE ID no. ME02549 at SEQ ID NO. 590
MASPRHRQDGDGPHDGAPTYAGMAKLVPALPLETRCPPFALRRYGGFWLPEAALRRGLPALHAGFAPRRADVLLASYPKSGTTWLKALAFATVRRAVHPPSSIDHPLRRRNPQDCVPFLEFDFDHGDMAELEALPSPRVLATHLPYSLLPDRVVADDGARIVYVCRDPKDALVSSWLFTRKASPSVGVDSDSYSLQEAAELFREGRCFYGPQCRHVLEYWDASRRPFGGGEVLFLRYEEMLRDPAGSLKTMAEFMGCGFSEEEVARGVVDEIVDLCSLEKLKNMEANRDGRRNASGIRSDSFFRKGVAGDWSSHMSPEMGKMLDEAVEEALQGSGFSFSG

SEQ ID NO: 608 - protein, 349 aa, Oryza sativa subsp. indica
  misc_feature: Public GI ID no.125562170
  misc_feature: Bit score of 405.3 for HMM based on sequences of FIGURE 4.
  misc_feature (124)..(346): Pfam Name: Sulfotransfer_1 Pfam Description: Sulfotransferase domain
  misc_feature: Functional Homolog Of Ceres SEEDLINE ID no. ME02549 at SEQ ID NO. 590
MAQGQLDAESVVPTATGVRRRGRRFWLFRFRSCFLDRFRRRICLSLGCTANILASLPTREGWWTAFVLYHGCWMTQQAATSVSLPRWCTPSSRGAPTMCSSPPTQSAAPPGSRCSPSPSPTAAAAGDHPLLTQSPHDLVPFIEVPFHHLHPLAALDALPSPRLLSTHMPPQLLPRRVAELGCRIVYLCREPKDVVVSLWHYMNKGLRAVCRWLLPVRQYGPIWDHCLGYWKKSMEEPDMVLFLKYDDMMADPAGHVKKLAEFLRAPFTDEEVGAGVVEEVVRLCSFEKLSRLPVNSSGVVDRSSGRPMENSVFFRKGEVGDWKNYLTEEMAKKLDAVIEEKLKGSGLTF

SEQ ID NO: 609 - DNA, 1390 bp, Panicum virgatum
  misc_feature: Ceres CLONE ID no.1797059
  misc_feature: Encodes the peptide sequence at SEQ ID NO 610
ctcacagtgatctgaaacactcataaaaaaattcggtgaactagtcgcgtagcatggcaacgcatccaaagcagcaccaggagagcaaaggtgaggggatggcggccggcaagggcgacgagtccaccccgacaaacggcggcggcgtcctcccggccaacttcgccgaggtggtggcctcccttccccaagggccgcagtgctccatgtttccttccctccgccattaccgcggcttctggatcccggagatcagcctgctgagcctccccgaggtccacgcccgcttcgcgctgagccccacggatgtcctcgtcgcgagcttccccaagtgcggcaccacctggctcaagtccctttgcttcgccgccgcgcgccggtcctcccacccgccactcgacggcgggcacccgctcctccgccgcaacgcacacgactgcgtcaggtccatcgacacccttcggttcctgcaaggcggcggggacgacgacggcgaggcgccgcgcctcctcgggactcacctgccctactccctgctcccggcgcgcgccacggcggaggacggctccgggtgccggatcgtgtacgtcatccgggaccccaaggacacgctggtctccctctggcacttcaactccggcgtggtgctgacggcgccaggcggcggcgacgccaacggcgcgccgccgccaccggagaagaccaagttcgaggaggcgttcgagctcttctgccagggccactacgggctgggcccgcagtgggagcacgcccgcgagtactgggaggcgagcaggcggcgccccgtcagcgtgctgtgcctcaggtacgaggagatgctgcgggaccccgcgggcaacctgaggaagatcgcggcgttcatggggtgcccgttctcggaggcggaggaggaggccggcgtcgtgcgcgccatcctcgagctgtgcggcatggagaagcagcggagcctggcggtgaacaggagcggggcctacgtggtcaaggacctgctcaccatcggcaaccagcatttcttcaggaagggggtggcgggggactggaggaaccacatgacgccggagatggcggcgaggttggacggcatcgtcgaggaggcgctccagggttcaggattttcctttggcgacgcaagtagctaaggcaaatgcgtacgtggctctgaataatcatgccggccatttcggtttggcatcagcttggtgtgttggcctatgagtcgtttgttcagccgatgctgtttgtgtggcatctgtatgtgttgtttccgtttgtttccctttgttacgtgtctttgtgattttattacttcttctaataaattctcggcaaatctcttgccgtccttttccaaaaaaaaaaaaaaaaaaaa

SEQ ID NO: 610 - protein, 368 aa, Panicum virgatum
  misc_feature: Ceres CLONE ID no.1797059
  misc_feature: Bit score of 255.4 for HMM based on sequences of FIGURE 4.
  misc_feature (83)..(360): Pfam Name: Sulfotransfer_1 Pfam Description: Sulfotransferase domain
  misc_feature: Functional Homolog Of Ceres SEEDLINE ID no. ME02549 at SEQ ID NO. 590
MATHPKQHQESKGEGMAAGKGDESTPTNGGGVLPANFAEVVASLPQGPQCSMFPSLRHYRGFWIPEISLLSLPEVHARFALSPTDVLVASFPKCGTTWLKSLCFAAARRSSHPPLDGGHPLLRRNAHDCVRSIDTLRFLQGGGDDDGEAPRLLGTHLPYSLLPARATAEDGSGCRIVYVIRDPKDTLVSLWHFNSGVVLTAPGGGDANGAPPPPEKTKFEEAFELFCQGHYGLGPQWEHAREYWEASRRRPVSVLCLRYEEMLRDPAGNLRKIAAFMGCPFSEAEEEAGVVRAILELCGMEKQRSLAVNRSGAYVVKDLLTIGNQHFFRKGVAGDWRNHMTPEMAARLDGIVEEALQGSGFSFGDASS

SEQ ID NO: 611 - DNA, 1262 bp, Triticum aestivum
  misc_feature: Ceres CLONE ID no.1031510
  misc_feature: Encodes the peptide sequence at SEQ ID NO 612
aagatctcagtgccatggattctgctcatgacgacggctttgcgtcggagatggcggagctgccgctggagacgcggtgcccgccgttcgcgctgcgccagtactccggcttctggctgccggaggcggtgctggcgcgcggtctcccggcggcgcatgaccggttcgcgccgaggccgaacgacgtgctcctcgccagcttccccaagtccggcaccacgtggctcaaggcgctcgccttcgccaccgtgcaccgggacacgcacccaccgtccgctgacgaccacccgctccgccgcctcagcccgcacggttgcgttccgttcctcgagatcagcctcgcgttcgccgacgacgtgggcgccgtggcggccgagctgggggcgctcccttccccgcgcgtgctcgccacgcacctgcccttctccctcctccctggacgcctcgccgccgccggccgggtcgtgtacatctgccgggaccccaaggacgcgctcgtctcctcgtgcttcttcaccaggaaggtgtcgaagcacctgggcgtcgacgcggagtccttctcgctccgggaggccgtggagctcttcagcgcggggcgctgcctcgtcggcccgcagtggcggcacgtcgttgagtactgggaggccagcctcagccgtcggaacgtgttgttcctcaggtatgaggagatgctccgcgaccccgtggggaacctcaggacgatggcagagttcatggggtgcgccttctcgccgggggaggaggagcgaggcgtgccgcaggccatcgtggagctgtgcagcctggagaagctcaagaatgtggaggcgagtcggggcggcggaaggacggtagatggcatcaaggccgacgcctacttcaggaagggggtggccggggattggagcagccacatgacgccggagatggggaagatggtggacgaggctgtggaggacgggctccggggatctggttttagcttcgccgactcaactccggccaaccctgaaaaatgacagagtcgaagcgaacccagatcgtccccggcaccacctacttcttggttcaataatgcatgctttgtgtccttgtttttgagtccggtgtgtgtgcgcgcgcgcgatgcatattgtccacgtactgtccattcatgtatgcgtacttttctttggcttccagaactcaactcaactgagctgaaatatgtgtgtgcttttagcattgaactgaaccgatatgctacaaaaaaaaaaaaaaaa

SEQ ID NO: 612 - protein, 334 aa, Triticum aestivum
  misc_feature: Ceres CLONE ID no.1031510
  misc_feature: Bit score of 277.5 for HMM based on sequences of FIGURE 4.
  misc_feature (55)..(321): Pfam Name: Sulfotransfer_1 Pfam Description: Sulfotransferase domain
  misc_feature: Functional Homolog Of Ceres SEEDLINE ID no. ME02549 at SEQ ID NO. 590
MDSAHDDGFASEMAELPLETRCPPFALRQYSGFWLPEAVLARGLPAAHDRFAPRPNDVLLASFPKSGTTWLKALAFATVHRDTHPPSADDHPLRRLSPHGCVPFLEISLAFADDVGAVAAELGALPSPRVLATHLPFSLLPGRLAAAGRVVYICRDPKDALVSSCFFTRKVSKHLGVDAESFSLREAVELFSAGRCLVGPQWRHVVEYWEASLSRRNVLFLRYEEMLRDPVGNLRTMAEFMGCAFSPGEEERGVPQAIVELCSLEKLKNVEASRGGGRTVDGIKADAYFRKGVAGDWSSHMTPEMGKMVDEAVEDGLRGSGFSFADSTPANPEK

SEQ ID NO: 613 - DNA, 1075 bp, Gossypium hirsutum
  misc_feature: Ceres CLONE ID no.1973081
  misc_feature: Encodes the peptide sequence at SEQ ID NO 614
cttttgaagagatgatatctactctgcctaaagagaattgttggggttattccgaagatcaatatcaatatcaaggtttttggttcaccccgcgttttctacgaggagcgttgtcggctcaacaacaattccaggctcaaccaactgatatcatcctttgcagctctccaagaacaggcacagcctggttaaaatccctcactttcgccactattacaagaacttcatacaatgattccaccacccctttactttccaagatgccccatgatgttgtgcctttcatggagttcgatcatgcccagttttccactaatcgacatcttggaattcctcttttagccactcatcttccttattctttcttacccagatctataattgattctggttgtaaacttatttacatttgcagggaccccaaagatacatttgtttcattgtatcatttcattgcacggtactacaaatcccaaaatactcaacccattcaacttgatgaagcgttcgaattgttctatgaaggtgtaagtctgtatgggccttattgggaccatgttttggggtactggaaagcaagtttggaacgtccggacaagttaatgttcttgaaatacgaagatttggttgaagatactgttttgtatcttaagaaaacagcagagtttatgggttatcctttctcgtcagaggaacaacaataaggggtgcctgaaaacattgtgaagatgtgcagtttcgacaatttaagtggcttggaagtaaataaaaccgggagacatcgtgaaacggaaaatagcattttcttccggaacgggaaggttggagactggaagaattatttgaccactaaaatggctcaacgtttagaccaacgaacaatgcaaaagttgagcggttcaggtttaagtctctaattgaagatctataatctatgtatcatccattgttgacttaaaacatgattagggctcggtattatttcttttaataatattaccttcaaataagatcatcttggttgacatttgtaattatccattatcttatttcttaaaaaaaaaaaaaaaaaaaa

SEQ ID NO: 614 - protein, 230 aa, Gossypium hirsutum
  misc_feature: Ceres CLONE ID no.1973081
  misc_feature: Bit score of 128.2 for HMM based on sequences of FIGURE 4.
  misc_feature (44)..(228): Pfam Name: Sulfotransfer_1 Pfam Description: Sulfotransferase domain
  misc_feature: Functional Homolog Of Ceres SEEDLINE ID no. ME02549 at SEQ ID NO. 590
MISTLPKENCWGYSEDQYQYQGFWFTPRFLRGALSAQQQFQAQPTDIILCSSPRTGTAWLKSLTFATITRTSYNDSTTPLLSKMPHDVVPFMEFDHAQFSTNRHLGIPLLATHLPYSFLPRSIIDSGCKLIYICRDPKDTFVSLYHFIARYYKSQNTQPIQLDEAFELFYEGVSLYGPYWDHVLGYWKASLERPDKLMFLKYEDLVEDTVLYLKKTAEFMGYPFSSEEQQ

SEQ ID NO: 615 - protein, 335 aa, Oryza sativa subsp. indica
  misc_feature: Public GI ID no.125561002
  misc_feature: Bit score of 247.4 for HMM based on sequences of FIGURE 4.
  misc_feature (81)..(332): Pfam Name: Sulfotransfer_1 Pfam Description: Sulfotransferase domain
  misc_feature: Functional Homolog Of Ceres SEEDLINE ID no. ME02549 at SEQ ID NO. 590
MSTTAKLAGLLRDEQGPVAFNDAVDEDAVPVEPLTEHDDAIFAMPAAHCDNMQFRCYRGFWISEMWAPGVVAVHRSFAPRADDVIVASLQKSGTTWLKALTLATMARGAWPPSSHDHPLRRLNPHLCVPSLEVLYTQGRDALLDMLPSPRLLSTHMPLSLLPPSTCKIVYICRDQKETAVSLWHFMKRRHPDLTFSEVHEAFCNGICMGGPAWDNILEFWYASNAEPTRVLFLTYEKVLQDPCDAVKKLAQFLGQPFSGAEEEAGVVTEITDLCSIDNLRNQKANKYGFIGGKISHESFFRKGMAGDWTNHMTLEMAERLDSILREKLDGSGLIV

SEQ ID NO: 616 - protein, 376 aa, Oryza sativa subsp. indica
  misc_feature: Public GI ID no.125541732
  misc_feature: Bit score of 206.0 for HMM based on sequences of FIGURE 4.
  misc_feature (80)..(373): Pfam Name: Sulfotransfer_1 Pfam Description: Sulfotransferase domain
  misc_feature: Functional Homolog Of Ceres SEEDLINE ID no. ME02549 at SEQ ID NO. 590
MAGPVPFVDVVVDNAGGAVANKADPGVVLPQEEEYESFLSSLPSNPKLQLLRYQGKWLLQSWVPGIIAIQRGGFAPRRGGGDVVLASLPKCGTTWLKALAFATMARRAHPPAGDEQHPLLRLNPHDCVPSMEKLFAAGLGSKIMDALPSPRLMATHVHHSLLPASITDNPHCKIIYICSPTLLFFLPLKIESWWKWLTCEFSSPTSLKVSLWHFVRRRLPEIPFLELFESACEGRCLSSPIWDHILGYWNASKTRPETVLFLRYEELLHDPADSVRKLARFVGQPFSPEEEEAGDVEDIVRLCSFEQMKNLEVNRAAGLSPALQQNAYTNGSFFRKGGTGDWANHMTPEMAERAARRHRRREAPLIRPLFLMISAC

SEQ ID NO: 617 - protein, 422 aa, Oryza sativa subsp. indica
  misc_feature: Public GI ID no.125560677
  misc_feature: Bit score of 171.0 for HMM based on sequences of FIGURE 4.
  misc_feature (102)..(419): Pfam Name: Sulfotransfer_1 Pfam Description: Sulfotransferase domain
  misc_feature: Functional Homolog Of Ceres SEEDLINE ID no. ME02549 at SEQ ID NO. 590
MGSTGEVMLASGGGAAPAPATSRDGRGAAAGLGPVAFKDAADADAIPVRPPTEHDAAVSAMPARVFHNLKLRQHQGYWVLDAWARGAVAMQRGGGGLVPRADGDVLLASLPKSGTTWLKALAFAVMARAAHPPASPDHPLRRLNPHDCVPLVDRLFAAGRDAVLDELPSPRLMCTHMPLSLLPATVADGSSGCKIIYICRRMDPDDDVQGGDVQARQGVQRHGTLRCSSPCSPSTAAAPAYTTARTGYSWMALRRGRSHSSPDQKDALVSMWHFLKRNGLQNLYESFCEGTCFGGPVWNHILEYWRASKANPSRVLFLRYERLLQDPTDSIRELAEFVGQPFTSSEEEAGVVTEIVELCSMENLMSQKANKEGAQGVFIKFSHDSYFRKGVAGGWTSHMTPEMGRRLDAILRDKFDGSGLTI

SEQ ID NO: 618 - protein, 456 aa, Oryza sativa subsp. indica
  misc_feature: Public GI ID no.125559115
  misc_feature: Bit score of 176.2 for HMM based on sequences of FIGURE 4.
  misc_feature (75)..(451): Pfam Name: Sulfotransfer_1 Pfam Description: Sulfotransferase domain
  misc_feature: Functional Homolog Of Ceres SEEDLINE ID no. ME02549 at SEQ ID NO. 590
MQPTSAAAGPVPFKDIAAVAVARRPVAEEYGDVVAALPSRLYPPQQRWREYQGAWFREAWVPGIVALQRRFEPRAGDVLLASLPKCGTTWLKALAFATAARGVYPPAAAGGDGRHPLLRLNPHECVPFLEGIYLDGEEAKLDAAPTPRLMSTHASYPNLPASITEDDRCKIIYICRGTKEKLLGGLVPTAGKWRRYCGAGRGPHRRLRAEALFWGRRPQHPLAPDASGGGGYAPAAPRDGGVGGAVPSGEGGVAAAQTAVLRPTMATAKTMRGDREQPKDMAISLWHFMNCSKAKTSSLSDDQWESITMSLSDVWESIREGAYLGGPIWEHILGYWNTSKAKPDKVLFLKYEEVLHDPTKNIEKIAEFIGQPFSDAEKEAGIVESIIELCSFEKMKASGANSTGSLHMMANEYPHESFFRKGVIGDWVNHVTPEMADSLDKFLSAKFYGSGFTFAE

SEQ ID NO: 619 - protein, 359 aa, Arabidopsis thaliana
  misc_feature: Public GI ID no.15809903
  misc_feature: Bit score of 930.4 for HMM based on sequences of FIGURE 4.
  misc_feature (91)..(353): Pfam Name: Sulfotransfer_1 Pfam Description: Sulfotransferase domain
  misc_feature: Functional Homolog Of Ceres SEEDLINE ID no. ME02549 at SEQ ID NO. 590
MATSSMKSIPMAIPSFSMCHKLELLKEGKTRDVPKAEEDEGLSCEFQEMLDSLPKERGWRTRYLYLFQGFWCQAKEIQAIMSFQKHFQSLENDVVLATIPKSGTTWLKALTFTILNRHRFDPVASSTNHPLFTSNPHDLVPFFEYKLYANGDVPDLSGLASPRTFATHLPFGSLKETIEKPGVKVVYLCRNPFDTFISSWHYTNNIKSESVSPVLLDQAFDLYCRGVIGFAPFWEHMLGYWRESLKRPEKVFFLRYEDLKDDIETNLKRLATFLELPFTEEEERKGVVKAIAELCSFENLKKLEVNKSNKSIKNFENRFLFRKGEVSDWVNYLSPSQVERLSALVDDKLGGSGLTFRLS

SEQ ID NO: 620 - protein, 347 aa, Arabidopsis thaliana
  misc_feature: Public GI ID no.30681703
  misc_feature: Bit score of 787.4 for HMM based on sequences of FIGURE 4.
  misc_feature (77)..(341): Pfam Name: Sulfotransfer_1 Pfam Description: Sulfotransferase domain
  misc_feature: Functional Homolog Of Ceres SEEDLINE ID no. ME02549 at SEQ ID NO. 590
MAIPSFSMCHKPELLKEGKSEGQEEEGLSYEFQEMLDSLPKERGRRNRYLYLFQGFRCQAKEIQAITSFQKHFQSLPDDVVLATIPKSGTTWLKALTFTILTRHRFDPVSSSSSDHPLLTSNPHDLVPFFEYKLYANGNVPDLSGLASPRTFATHVPFGALKDSVENPSVKVVYLCRNPFDTFISMWHYINNITSESVSAVLLDEAFDLYCRGLLIGFGPFWEHMLGYWRESLKRPEKVLFLKYEDLKEDIETNLKKLASFLGLPFTEEEEQKGVVKAIADLCSFENLKKLEVNKSSKLIQNYENRFLFRKGEVSDLVNYLSPSQVERLSALVDDKLAGSGLTFRLS

SEQ ID NO: 621 - protein, 340 aa, Arabidopsis thaliana
  misc_feature: Public GI ID no.9759556
  misc_feature: Bit score of 767.5 for HMM based on sequences of FIGURE 4.
  misc_feature (70)..(334): Pfam Name: Sulfotransfer_1 Pfam Description: Sulfotransferase domain
  misc_feature: Functional Homolog Of Ceres SEEDLINE ID no. ME02549 at SEQ ID NO. 590
MCHKPELLKEGKSEGQEEEGLSYEFQEMLDSLPKERGRRNRYLYLFQGFRCQAKEIQAITSFQKHFQSLPDDVVLATIPKSGTTWLKALTFTILTRHRFDPVSSSSSDHPLLTSNPHDLVPFFEYKLYANGNVPDLSGLASPRTFATHVPFGALKDSVENPSVKVVYLCRNPFDTFISMWHYINNITSESVSAVLLDEAFDLYCRGLLIGFGPFWEHMLGYWRESLKRPEKVLFLKYEDLKEDIETNLKKLASFLGLPFTEEEEQKGVVKAIADLCSFENLKKLEVNKSSKLIQNYENRFLFRKGEVSDLVNYLSPSQVERLSALVDDKLAGSGLTFRLS

SEQ ID NO: 622 - DNA, 1233 bp, Populus balsamifera subsp. trichocarpa
  misc_feature: Ceres ANNOT ID no.1501305
  misc_feature: Encodes the peptide sequence at SEQ ID NO 623
atgcctgcctctactacaacttccatggttctcaaccatttcacaaagaatcaagcaaatgacaatggagaggatttagagagattaaccaatgagtgcaaggaattgctgctttcactcccaagagagaagggttggagaactgcatgcctctataaatacaaagggttttggtgccaaccaaaagaaatccaagcgataatctcttttcaaaaacactttgaaccaagagacactgatgttatcctagcatcaatacctaaatcaggaactacctggctcaaagccctatcttttgccatcttgaatcgcaagaaatttgcaatctctagtaatgaccaccctttgctcgtctctaatcctcacgatcttgcacctttctttgagtacaagctttatgcagacaagcaagttcctgacctctcgaaactccctgatcctagactttttgccacccacattccatttgcttcacttcaagactccatcaagaagtctaattgccggattatttatatctgtagaaacccttttgacacttttatttcctcatggactttcagcaacaagctgagatcagaaactgttcctccactgttactagaggaaaccttcaaaatgtattgcgaaggggttgtagggttcggtcccttctgggaccatatgttgggatactggaaggaaagcttggagagacaagacaaggtgttgttcttgaagtatgaggacatgaaagcagatgttacgttttacttgaagaagattgccaaatttcttggctgccctttttcaatggaagaagaaaaggaaggtgtagtggaaaagatagccagcctttgtagctttgagaagatgaagaatttagaagttaacaaatctggaaggtctattacgaacttcgaaaataagcacttgtttaggaaagctgaagtcggagattgggtgaattatctgtctccttcaatggtgaagcaattatctcaattaatagaggaaaagttgggtggatctggtattgaattcaaagtgtttccttatactagcactactccgtctacatctccaaggcttttcgctgctcacattccctattcatcattgcccgaatccatcaagaagtctaattgtcgtgaagtttacatttatcgtaacccttttaacgtggtggcatcctggtttcatttttccaatgttgaaggtgaaccagagaagctggatgaggagtatttttga

SEQ ID NO: 623 - protein, 410 aa, Populus balsamifera subsp. trichocarpa
  misc_feature: Ceres ANNOT ID no.1501305
  misc_feature: Bit score of 1150.8 for HMM based on sequences of FIGURE 4.
  misc_feature (78)..(338): Pfam Name: Sulfotransfer_1 Pfam Description: Sulfotransferase domain
  misc_feature: Functional Homolog Of Ceres SEEDLINE ID no. ME02549 at SEQ ID NO. 590
MPASTTTSMVLNHFTKNQANDNGEDLERLTNECKELLLSLPREKGWRTACLYKYKGFWCQPKEIQAIISFQKHFEPRDTDVILASIPKSGTTWLKALSFAILNRKKFAISSNDHPLLVSNPHDLAPFFEYKLYADKQVPDLSKLPDPRLFATHIPFASLQDSIKKSNCRIIYICRNPFDTFISSWTFSNKLRSETVPPLLLEETFKMYCEGVVGFGPFWDHMLGYWKESLERQDKVLFLKYEDMKADVTFYLKKIAKFLGCPFSMEEEKEGVVEKIASLCSFEKMKNLEVNKSGRSITNFENKHLFRKAEVGDWVNYLSPSMVKQLSQLIEEKLGGSGIEFKVFPYTSTTPSTSPRLFAAHIPYSSLPESIKKSNCREVYIYRNPFNVVASWFHFSNVEGEPEKLDEEYF

SEQ ID NO: 624 - DNA, 1119 bp, Populus balsamifera subsp. trichocarpa
  misc_feature: Ceres ANNOT ID no.1448303
  misc_feature: Encodes the peptide sequence at SEQ ID NO 625
atgcctgcctctactacaacttccatggttctcaaccatttcacaaagaatcaagcaaatgacaatggagaggatttagagagattaaccaatgagtgcaaggaattgctgctttcactcccaagagagaagggttggagaactgcatgcctctataaatacaaagggttttggtgccaaccaaaagaaatccaagcgataatctcttttcaaaaacactttgaaccaagagacactgatgttatcctagcatcaatacctaaatcaggaactacctggctcaaagccctatcttttgccatcttgaatcgcaagaaatttgcaatctctagtaatgaccaccctttgctcgtctctaatcctcacgatcttgcacctttctttgagtacaagctttatgcagacaagcaagttcctgacctctcgaaactccctgatcctagactttttgccacccacattccatttgcttcacttcaagactccatcaagaagtctaattgccggattatttatatctgtagaaacccttttgacacttttatttcctcatggactttcagcaacaagctgagatcagaaactgttcctccactgttactagaggaaaccttcaaaatgtattgcgaaggggttgtagggttcggtcccttctgggaccatatgttgggatactggaaggaaagcttggagagacaagacaaggtgttgttcttgaagtatgaggacatgaaagcagatgttacgttttacttgaagaagattgccaaatttcttggctgccctttttcaatggaagaagaaaaggaaggtgtagtggaaaagatagccagcctttgtagctttgagaagatgaagaatttagaagttaacaaatctggaaggtctattacgaacttcgaaaataagcacttgtttaggaaagctgaagtcggagattgggtgaattatctgtctccttcaatggtgaagcaattatctcaattaatagaggaaaagttgggtggatctggaggtgtccaagctgctgctgctgctgcttcttcttcttcttctgttataaagaagaaattcgagctacagagatatggagagaataagaatacaaatgtcaattga

SEQ ID NO: 625 - protein, 364 aa, Populus balsamifera subsp. trichocarpa
  misc_feature: Ceres ANNOT ID no.1448303
  misc_feature: Bit score of 886.1 for HMM based on sequences of FIGURE 4.
  misc_feature (70)..(330): Pfam Name: Sulfotransfer_1 Pfam Description: Sulfotransferase domain
  misc_feature: Functional Homolog Of Ceres SEEDLINE ID no. ME02549 at SEQ ID NO. 590
MVLNHFTKNQANDNGEDLERLTNECKELLLSLPREKGWRTACLYKYKGFWCQPKEIQAIISFQKHFEPRDTDVILASIPKSGTTWLKALSFAILNRKKFAISSNDHPLLVSNPHDLAPFFEYKLYADKQVPDLSKLPDPRLFATHIPFASLQDSIKKSNCRIIYICRNPFDTFISSWTFSNKLRSETVPPLLLEETFKMYCEGVVGFGPFWDHMLGYWKESLERQDKVLFLKYEDMKADVTFYLKKIAKFLGCPFSMEEEKEGVVEKIASLCSFEKMKNLEVNKSGRSITNFENKHLFRKAEVGDWVNYLSPSMVKQLSQLIEEKLGGSGGVQAAAAAASSSSSVIKKKFELQRYGENKNTNVN

SEQ ID NO: 626 - DNA, 1379 bp, Glycine max
  misc_feature: Ceres CLONE ID no.607280
  misc_feature: Encodes the peptide sequence at SEQ ID NO 627
gatgatgatttcttttaatttttcacaatgaaataatttgtgcgctcgaaacagaaagaaagctttgagtcgtccatcgctttcatccagtgtttgatctgtcggtagcatgattccttactagagatcgaccattagcactctaatggctccaacaaatgtcacatgcttcagagaagaaaatgaatccgagaaaggggaggaaataacaatagaagaagacaagctaagtcaagaatgtaaggagttgatactctctcttcctagggaaagaggttggagaacacgttatatatatctatttcaaggattttggtgccagccattggaaatccaagcaataatcacttttcagaagcacttccaagctaaagacagtgatgttattgtggccacaattccaaaatcaggtaccacttggctgaaagctctcacctttgccattgtcaatcgccatactcatagtatcactacatcaatgtcatcacatcctttgcttacttctaatcctcatgaacttgtgcctttcatagaatacaccgtttatggtaatgcccctagccatgttccaaacctatccaacatgactgagccaagactttttggtacacatattccattccatgcattggccaagtccatcaaggagtccaatagtagaataatttatatatgtaggaacccacttgacacttttgtgtctacttggattttcctcaacaaaattaagccagaacatttacctgaatttgaactaggggaagcttttgaaaagtattgcaaaggaataatagggtttggtccaacttgggaccaaatgttgggttattggaaggagagtatagctaggcctagtaaggttttgttcttgaagtacgaggatcttaaaaaagatgtcaattttcatgtgaaaagaatagcggagttcttaggatgtcctttcacttcggaggaagaaggtgatgggactattgagagcataatcaagctatgcagcttcgagaagatgaaggaattggaggcaaataaatctggaacatttgctaggaactttgagagaaagtacttgttccgaaaggctgaaatgggagattgggtgaactacctttcccctgaaatgggtgaaaagttatcgcaaattatggaagaaaagttaagtgggtcaggcttgtcattttaagtgtctccttatttttgttgatcgatcactagctagtgatcatcatctacatcaagtgtctaaataagaatcgtgcatatatgcaggtcatgatgtggcctacaagtgcatgttcgttgtgattttcccttttcccttttcccgtttggatgatttttcctactagtgcattgaaggtctcagtaaagttatttctatc

SEQ ID NO: 627 - protein, 344 aa, Glycine max
  misc_feature: Ceres CLONE ID no.607280
  misc_feature: Bit score of 922.5 for HMM based on sequences of FIGURE 4.
  misc_feature (77)..(341): Pfam Name: Sulfotransfer_1 Pfam Description: Sulfotransferase domain
  misc_feature: Functional Homolog Of Ceres SEEDLINE ID no. ME02549 at SEQ ID NO. 590
MAPTNVTCFREENESEKGEEITIEEDKLSQECKELILSLPRERGWRTRYIYLFQGFWCQPLEIQAIITFQKHFQAKDSDVIVATIPKSGTTWLKALTFAIVNRHTHSITTSMSSHPLLTSNPHELVPFIEYTVYGNAPSHVPNLSNMTEPRLFGTHIPFHALAKSIKESNSRIIYICRNPLDTFVSTWIFLNKIKPEHLPEFELGEAFEKYCKGIIGFGPTWDQMLGYWKESIARPSKVLFLKYEDLKKDVNFHVKRIAEFLGCPFTSEEEGDGTIESIIKLCSFEKMKELEANKSGTFARNFERKYLFRKAEMGDWVNYLSPEMGEKLSQIMEEKLSGSGLSF

SEQ ID NO: 628 - DNA, 1014 bp, Populus balsamifera subsp. trichocarpa
  misc_feature: Ceres ANNOT ID no.1448305
  misc_feature: Encodes the peptide sequence at SEQ ID NO 629
atggaagacattcaaattactcaaagaaacagtactgtttcagaaaccggagagagtgatcaatgccgtgatttactatcatcacttcccaaagagaaagactggatatcttgttatatgtatcttttccaaggcttttggtgccctccgaaggagattcatgctgtagtttcattccaaaataactttcaatcatgcaacactgacactatacttgtctccatgcctaaatcaggtacgacatggttgaaagccttggtattttccatcatgaaccgtgaaaaatatcaaaccgcagaaagccccttgaattctttcaaccctcatgatctcgtgcctttctttgagtataggctttatgcaaacaaccaagttcctgacctgtctgcatttccatcgcctagaatattttcaacccatgtgccatatccatcactgccagaatctatcaggaactctacttgtcgggttgtttatatatgtagaaatcccttggacaactttatctccttctggcatttcctctcaaaagcaagacctgagagacttggaccacttcttttggaggaggcttttgatagtttttgcaatggagttgtagggtttggtcccttttttgatcatgttctagggtattggaaggagagcttggagagaccagagaaggtattgtttcttaagtttgaggacttaaaagaagatatcaattctcagatgaaaagtctggctgtgttcttgggttgccccttttctttggaggaagagagggatggggttatagaggacatatccaagctgtgcagcctcgatagtctgaaggatatcgaggcaaacaagagaggtaagtctatcccatacttcgagaataatactttatttagaagaggtgaggttggggactggatcaattatcttactcctgagatggttgatcgtttaaacaagatcacagcacaaaagttggctggttctggattagagttcaagattactagtctagacaacaatgtttga

SEQ ID NO: 629 - protein, 337 aa, Populus balsamifera subsp. trichocarpa
  misc_feature: Ceres ANNOT ID no.1448305
  misc_feature: Bit score of 620.2 for HMM based on sequences of FIGURE 4.
  misc_feature (67)..(325): Pfam Name: Sulfotransfer_1 Pfam Description: Sulfotransferase domain
  misc_feature: Functional Homolog Of Ceres SEEDLINE ID no. ME02549 at SEQ ID NO. 590
MEDIQITQRNSTVSETGESDQCRDLLSSLPKEKDWISCYMYLFQGFWCPPKEIHAVVSFQNNFQSCNTDTILVSMPKSGTTWLKALVFSIMNREKYQTAESPLNSFNPHDLVPFFEYRLYANNQVPDLSAFPSPRIFSTHVPYPSLPESIRNSTCRVVYICRNPLDNFISFWHFLSKARPERLGPLLLEEAFDSFCNGVVGFGPFFDHVLGYWKESLERPEKVLFLKFEDLKEDINSQMKSLAVFLGCPFSLEEERDGVIEDISKLCSLDSLKDIEANKRGKSIPYFENNTLFRRGEVGDWINYLTPEMVDRLNKITAQKLAGSGLEFKITSLDNNV

SEQ ID NO: 630 - DNA, 993 bp, Populus balsamifera subsp. trichocarpa
  misc_feature: Ceres ANNOT ID no.1448307
  misc_feature: Encodes the peptide sequence at SEQ ID NO 631
atggaagacacccaaatgatcaccggaaacaacaatagtcttgcagaaaccgatgagattgctgacctcctgtcatcccttcccaaagaaaagtcatggcgattaggttatctgtatcgataccaaggcttttggtgtcctgaaaagcagattcctgctgtcattgcatttcaaaagcacttcatagcacagaaaacagatactatactagtcaccatgcctaaatcaggcacaacatggttgaaagccttggcattttccattatgaatcgtgcaaaatatacaccctcgtgtagccctttgaactctgtcaaccctcatgatcttgtgcctttctttgagtttgggctttacgcaaataaccaacttcctgacctgtctacctttccatcccctagaatgtttgctactcatgtgccatatccatcaataccggattccatcaagaactccggctgtcgaattgtttgtctttgcaggaatccatttgacaactttatctccttgtggcatttcgcctccaaagcaagacatgaaagtcttgggccattatctatggaggattgtttcgatagtttttgcaatggacttggaggattcggtcccttttttgaccacgtattagggtattggagagaaagcttagagagaccagaggaggttctgtttctcacgtatgaggacatgaaagaagacattaattctcagatgaaaaggttagctgagttcctgggctgtcctttttccttggaagaagaggcagatggggttgtggaaggaatatcaaagttgtgtagcttcagcaatatgaaggacaaagagatcaacaagactggtaagtctatcccacactttgagaacaagactctctttagaagaggtgaagtaggggattgggtcaattacctttctcctgagatggtggatcgtttgaacaaaatcatggaacaaaagctggctggttctggtttgaagttcaagactggtttgtag

SEQ ID NO: 631 - protein, 325 aa, Populus balsamifera subsp. trichocarpa
  misc_feature: Ceres ANNOT ID no.1448307
  misc_feature: Bit score of 591.9 for HMM based on sequences of FIGURE 4.
  misc_feature (60)..(318): Pfam Name: Sulfotransfer_1 Pfam Description: Sulfotransferase domain
  misc_feature: Functional Homolog Of Ceres SEEDLINE ID no. ME02549 at SEQ ID NO. 590
MITGNNNSLAETDEIADLLSSLPKEKSWRLGYLYRYQGFWCPEKQIPAVIAFQKHFIAQKTDTILVTMPKSGTTWLKALAFSIMNRAKYTPSCSPLNSVNPHDLVPFFEFGLYANNQLPDLSTFPSPRMFATHVPYPSIPDSIKNSGCRIVCLCRNPFDNFISLWHFASKARHESLGPLSMEDCFDSFCNGLGGFGPFFDHVLGYWRESLERPEEVLFLTYEDMKEDINSQMKRLAEFLGCPFSLEEEADGVVEGISKLCSFSNMKDKEINKTGKSIPHFENKTLFRRGEVGDWVNYLSPEMVDRLNKIMEQKLAGSGLKFKTGL

SEQ ID NO: 632 - protein, 348 aa, Medicago truncatula
  misc_feature: Public GI ID no.92887174
  misc_feature: Bit score of 902.6 for HMM based on sequences of FIGURE 4.
  misc_feature (76)..(341): Pfam Name: Sulfotransfer_1 Pfam Description: Sulfotransferase domain
  misc_feature: Functional Homolog Of Ceres SEEDLINE ID no. ME02549 at SEQ ID NO. 590
MASTDLTNMKEDQSRDGQETTSKVNKVSHDYNNLILSLPRENGCETQYMYFFHGFWCPSTLIQSVNSFQNNFHAKDSDIVVASIPKSGTTWLKGLAYAIVNRQHFTSLENNHPLLLFNPHELVPQFEVNLYGDKDGPLPQIDVSNMTEPRLFGTHMPFPSLPKSVKESNCKIIYICRNPFDTFVSYWIFINKIRLRKSLTELTLEESFERYCKGICLFGPFWDNMLGYLKESIERPDRVLFLKYEDLKEDVNFHTKRIAEFVGIPFTQEEENNGVIENIIKLCSFESMKEIEGNQSGTISGDIEKEFYFRKGEIGDWANYLSSSMVEKLSKVMEEKLNGSSLSFKVCA

SEQ ID NO: 633 - DNA, 1243 bp, Gossypium hirsutum
  misc_feature: Ceres CLONE ID no.1857162
  misc_feature: Encodes the peptide sequence at SEQ ID NO 634
agttttgggtggtgctagtttcacaagaaatctccaaagctagaatggtttcaaaatcacatgatgtgtactcctcttgggatgatgaattcaaaaaactggtgcaaagcttccccaaagagaaaggctgggcaggatccaatctttatttctatcaaggtttttggtgcccctctcttgttctaaaagcttttatttctttccagaaacattttcaagcatttaattctgatatcatcgttgctacttttccaaaatgtggtactacttggctcaaggccttgactttctccactttgtaccgcaatcagttcccatgggatgaaaatccattgctcacctttggccctcaccaacttgttcgtttcttcgagtatgatctttacttgaacaacccttttcctgatcttcgaaatgtttgtgcttatcagccaaggcttttttccacccacgccccttatgctactttgccaacttccattaaggattctggctgtaagattgtttacatatgtagaaaccccatggatatgttcatttctctttggcttttctctgccaagctccgagacaaaaaccaagagtcactatcactagatgaagcttttgacaagttctaccatggaatctctgcgcatggaccattttttgatcatgtattgggatattggaaggcaagccaagaaaaccccaacaaaatattgtttttgaactttgaagatcttaaggaagatatggattcccatttgaaaattttggccatgttcttaggagttcctttcacagatgatgaagagaaacaaggagttgttgaaaaaatagcgaaaatttgtagctttgagaacttgaaagaattggaagtgaacatgaaggacgtacatacttctggagttccacacacacatttttttaggaaaggagaagtgggagattggagcaattatctcacacccttcatgattgaatgtttggagaagcttattcaagagaaattgaatggctcgggtttaacatttaaactgctctccgaaactgcaaacaatattgcttctccatgatcgcggggatgtcttctagcttttttgggaatgaaatctcttttattcccattttctttataaataatctgtactagagttctcttgtaatcatgatcagaataaattgctttgaggtatgttttgtggattttatgtgaaaataaatgaagttgcattaaacataaaaaaaaaaaaaaaaaaaa

SEQ ID NO: 634 - protein, 337 aa, Gossypium hirsutum
  misc_feature: Ceres CLONE ID no.1857162
  misc_feature: Bit score of 872.6 for HMM based on sequences of FIGURE 4.
  misc_feature (61)..(321): Pfam Name: Sulfotransfer_1 Pfam Description: Sulfotransferase domain
  misc_feature: Functional Homolog Of Ceres SEEDLINE ID no. ME02549 at SEQ ID NO. 590
MVSKSHDVYSSWDDEFKKLVQSFPKEKGWAGSNLYFYQGFWCPSLVLKAFISFQKHFQAFNSDIIVATFPKCGTTWLKALTFSTLYRNQFPWDENPLLTFGPHQLVRFFEYDLYLNNPFPDLRNVCAYQPRLFSTHAPYATLPTSIKDSGCKIVYICRNPMDMFISLWLFSAKLRDKNQESLSLDEAFDKFYHGISAHGPFFDHVLGYWKASQENPNKILFLNFEDLKEDMDSHLKILAMFLGVPFTDDEEKQGVVEKIAKICSFENLKELEVNMKDVHTSGVPHTHFFRKGEVGDWSNYLTPFMIECLEKLIQEKLNGSGLTFKLLSETANNIASP

SEQ ID NO: 635 - protein, 333 aa, Medicago truncatula
  misc_feature: Public GI ID no.92888243
  misc_feature: Bit score of 536.8 for HMM based on sequences of FIGURE 4.
  misc_feature (69)..(330): Pfam Name: Sulfotransfer_1 Pfam Description: Sulfotransferase domain
  misc_feature: Functional Homolog Of Ceres SEEDLINE ID no. ME02549 at SEQ ID NO. 590
MTKSSDENPTLPKYLKEDDLGQECKDLIQTLPLVEGWIDPTFHEYQGFWFAPKILQGALSFQKHFQAIDTDIILVTNPKSGTTWLKALTFALINRNKYPNIHKNHPLLTSNPHVLVPFMEINLYYETDIVPELNSLSPPRIFSTHNPYVLLPKSLKESNCKVVYLCRDPKDTFVSLWHFSNKLREQSRGTLPLEEAFESFCRGTTSYGPFWDHVLGYWKESLERPEKVMFLKYEEMKMKPNFVLKEIAKFLGCPFSEEEESNGVVDDILHLCSFEKLSNLEINKNGKISSEIENKNFFRLGKVGDWKNLLTTKMVEQLNIVVEEKFGKHGLSF

SEQ ID NO: 636 - protein, 349 aa, Medicago truncatula
  misc_feature: Public GI ID no.92879395
  misc_feature: Bit score of 743.3 for HMM based on sequences of FIGURE 4.
  misc_feature (77)..(342): Pfam Name: Sulfotransfer_1 Pfam Description: Sulfotransferase domain
  misc_feature: Functional Homolog Of Ceres SEEDLINE ID no. ME02549 at SEQ ID NO. 590
MASTDLKHMKEDQSRDGQEKISEENKVIHDYNNLILSLPREDDGSVSQYLYFYHEFWCPSTFIQSTISFQNNFHAKDSDIIAASMPKSGSTWLKGLAYAIVNRQYFTSLENKHPLLLSNPHELVPQFEASLYGGKDPVLTQVDVPNMTEPRLFGTHMPFPSLPKSVKESNCKIIYICRNPFDIFVSYWTFFNKIRLKKSLTELTLEEAFERYCKGICIFGPFWENMLGYFKESIERPYRVLFLKYEDLKEDVNFNIKRIAEFVGIPFTQEEENNGVIENIIKLCSFESMKESNGNNSGTVTVNVDREFFFRKGEIGDWVNYFSPSMIERLSKIMQEKFSGSSLSFKGCP

SEQ ID NO: 637 - DNA, 1207 bp, Glycine max
  misc_feature: Ceres CLONE ID no.528876
  misc_feature: Encodes the peptide sequence at SEQ ID NO 638
gaaaacacaagcaatcctcaggatcgaatccctttctctcgatccacacaatgccaacggaagctgaatctagtgttacgcccaaatacctgcaagagaatgaactgagccaagagtgtaaggaagtgatatccaccttacccatggaaagaggttgggttgcaagccatctgcaccaatatcaaggcttctggcacaccaccaggcagcttcaaggggttctatcttgtcaaaagcattttaaggcccttgacacagatgtcctcattgtaagcactcccaaatcaggcaccacttggctcaaagcttggacattttccttgcttcacagaaaccaacatgatccaaatacccaaaaccaaaaccatcctttgctattcaacaacccccattttcttgttccattcttggaactagacctctacattgatgacaacactcttcccgaccttacttcattgatcacctctccaaggctcttctccacacatctcccttatgtgtcacttccaaaatctgtgcaagaatcagcttgcaagatcatttatctctgtagagaccccaaagatgctttcatttcactatggcatttcacaaacatgcttaggcccaagagccgagggatgaactcactccaagaggcatttgacaagttttgcagaggagtgagtctctatgggcccttctgggcccatgtgttggactattggcagaagagcctgtcagagcccaacaagatcatgtttatgaggtttgaagaaatgaaaatgaagcttaggcttgttttgcaagagcttgctacttttgtgggttgcccgttttccaaagaagaggaggaagctggtgtggtgaatcatattttgaagctgtgtagctttgataacttgagcaacttgcaagtgaacaagaatgggaaactctcctctggtgaagaacacaaagctttcttccgctgtggccaaattggtgactgcaaaaatcatctcactgctgagatgatccaacaactcaacaccatcactcaagagaaactagctgaacatggactgaggttttagattatatcgttattatttgcaatttttaatacttggtattatgtcatgtgtgcaaaaaaataaatagaattccttttaaatctagcttttgaggggatgaaacaaaagggacgagagaaactcacattttcctcgccaaagcgtgcaat

SEQ ID NO: 638 - protein, 335 aa, Glycine max
  misc_feature: Ceres CLONE ID no.528876
  misc_feature: Bit score of 462.8 for HMM based on sequences of FIGURE 4.
  misc_feature (68)..(332): Pfam Name: Sulfotransfer_1 Pfam Description: Sulfotransferase domain
  misc_feature: Functional Homolog Of Ceres SEEDLINE ID no. ME02549 at SEQ ID NO. 590
MPTEAESSVTPKYLQENELSQECKEVISTLPMERGWVASHLHQYQGFWHTTRQLQGVLSCQKHFKALDTDVLIVSTPKSGTTWLKAWTFSLLHRNQHDPNTQNQNHPLLFNNPHFLVPFLELDLYIDDNTLPDLTSLITSPRLFSTHLPYVSLPKSVQESACKIIYLCRDPKDAFISLWHFTNMLRPKSRGMNSLQEAFDKFCRGVSLYGPFWAHVLDYWQKSLSEPNKIMFMRFEEMKMKLRLVLQELATFVGCPFSKEEEEAGVVNHILKLCSFDNLSNLQVNKNGKLSSGEEHKAFFRCGQIGDCKNHLTAEMIQQLNTITQEKLAEHGLRF

SEQ ID NO: 639 - DNA, 993 bp, Populus balsamifera subsp. trichocarpa
  misc_feature: Ceres ANNOT ID no.1448352
  misc_feature: Encodes the peptide sequence at SEQ ID NO 640
atggagacgaccacaatctcttcaaacggagaaagggagctaaaagatgagattcaaggcttggttgcaagctttcctagtgagaaaaactgggatggagctcccctttatttctataaaggggtctggtatccagttttcgccattagaggggctctttcctttcaacaacatttcattgcacaggacacagatataatactagcgagcatgccaaaatcaggcaccacctggttaaaagctctcacgttctctgttgtaaaccgcaacatttacagtcccaaagagagtcccttactcactaccccacctcatgaactcgttcgtttctttgagatggacctttactcaaaaaaccagctcccagatctcaaacaacttccttcccctaggattttcagctctcactcccattacagaaccttgccacagtccattagagattctggttgcaagattgtttacatatgcaggaatcctttggatcaacttgtctcttattttcattttgctcgcaagttcaaacgagagaatgtcaagcctttatcatcaattgatgaaggtttcgacaacgtttgtcttggtatccagagttatggacccttttgggatagcgtgttggggtactggaaagcaagtttggaaagaccagacaaggtgctgtttttgaaatatgaagatttgaaagaggatataacttttagcttgaagaaactagcagagttcctggtattgcctttctctgagaaagaagagaaagaaggggtcattgaagaaatatcaaagctgtgcagctttgacaatctcaaggatttggaagtgaacagaactggtttctttgaaagcgctggagctccaaacagtaccttctttaggaaagcaaaggtgggagattggtgcaatgatctaagtccttccatggcagaatgttttttgaagatagtggaagaaaagttggctggctctggcttatccttcaaagtatctgaataa

SEQ ID NO: 640 - protein, 330 aa, Populus balsamifera subsp. trichocarpa
  misc_feature: Ceres ANNOT ID no.1448352
  misc_feature: Bit score of 531.8 for HMM based on sequences of FIGURE 4.
  misc_feature (63)..(323): Pfam Name: Sulfotransfer_1 Pfam Description: Sulfotransferase domain
  misc_feature: Functional Homolog Of Ceres SEEDLINE ID no. ME02549 at SEQ ID NO. 590
METTTISSNGERELKDEIQGLVASFPSEKNWDGAPLYFYKGVWYPVFAIRGALSFQQHFIAQDTDIILASMPKSGTTWLKALTFSVVNRNIYSPKESPLLTTPPHELVRFFEMDLYSKNQLPDLKQLPSPRIFSSHSHYRTLPQSIRDSGCKIVYICRNPLDQLVSYFHFARKFKRENVKPLSSIDEGFDNVCLGIQSYGPFWDSVLGYWKASLERPDKVLFLKYEDLKEDITFSLKKLAEFLVLPFSEKEEKEGVIEEISKLCSFDNLKDLEVNRTGFFESAGAPNSTFFRKAKVGDWCNDLSPSMAECFLKIVEEKLAGSGLSFKVSE

SEQ ID NO: 641 - DNA, 1224 bp, Populus balsamifera subsp. trichocarpa
  misc_feature: Ceres ANNOT ID no.1437745
  misc_feature: Encodes the peptide sequence at SEQ ID NO 642
atggatttgcctccaatgaatgcgtggagagctttcttgctgatgctggaaaagatcattaaccacgtaaatgtattctcctatataaaaatggtgattgacacaatcctgccgacacaggcaagtgcttgtcgagtatattataatttgctttgttctgaaagctttagacgtgccattgatccatcgagttccccacctgcaccattcctcactgtctctcacacaattacaattatcattttcatggagacagtcaaagaagataatctccaagaatttctactcacccttccaagtgagaaaaactgggatggtactcccctccttcttttcaatgagacctggtatccagccaactccattagaggtgcagtttcctttcaacaaaacttcagggcacaagactccgacataatactagcgagcatgccaaaatcaggcactacttggttgaaggccctcaccttctcggttgtaagccgtgatcgctacagccccaaagagagtcccttaatcactgccccaccacatgaactagtacctttccttgaggtggatctttacttgaaaagccagaacccagatcttgattttcctcctccaagaattctttcttgtcacacacattacacatctctgccacagtccattagagactccaactgtaaaattgtgtacgtgtgtaggaatcctttggatcaggctgtctctgattttgtttttgttcgaaacagagtatcaggcatcgcaaacccttcatcatcatcatcatcatcatcattaattgatgaaggtttcgagaatatttgtcgtggtgtccagagttacggacccttttggaataatgtgttgagctattggaaagcgagcttggaaagaccagacaaggtgttgtttttgaaatatgaggatctgaaagaggatattatcttgaacttgaagaggttagcagagttcttgggctttcccttcaccgaggaagaagagaaagaaggggttattgaagaaatttcaagactgtgtagttttgacaatctcaaggatttggaagtgaacaaaaatggtgtccgcccttctggaatgcgaaatagtgccttcttcaggaaaggagagacgggagattggggcaatcatcttagtccttccatggctgaacgtttctggaagatcgtggaagaaaagttggatggatctggtttaaccttcaaaatctctcagtaa

SEQ ID NO: 642 - protein, 393 aa, Populus balsamifera subsp. trichocarpa
  misc_feature: Ceres ANNOT ID no.1437745
  misc_feature: Bit score of 443.7 for HMM based on sequences of FIGURE 4.
  misc_feature (122)..(386): Pfam Name: Sulfotransfer_1 Pfam Description: Sulfotransferase domain
  misc_feature: Functional Homolog Of Ceres SEEDLINE ID no. ME02549 at SEQ ID NO. 590
MLEKIINHVNVFSYIKMVIDTILPTQASACRVYYNLLCSESFRRAIDPSSSPPAPFLTVSHTITIIIFMETVKEDNLQEFLLTLPSEKNWDGTPLLLFNETWYPANSIRGAVSFQQNFRAQDSDIILASMPKSGTTWLKALTFSVVSRDRYSPKESPLITAPPHELVPFLEVDLYLKSQNPDLDFPPPRILSCHTHYTSLPQSIRDSNCKIVYVCRNPLDQAVSDFVFVRNRVSGIANPSSSSSSSSLIDEGFENICRGVQSYGPFWNNVLSYWKASLERPDKVLFLKYEDLKEDIILNLKRLAEFLGFPFTEEEEKEGVIEEISRLCSFDNLKDLEVNKNGVRPSGMRNSAFFRKGETGDWGNHLSPSMAERFWKIVEEKLDGSGLTFKISQ

SEQ ID NO: 643 - DNA, 2892 bp, Populus balsamifera subsp. trichocarpa
  misc_feature: Ceres ANNOT ID no.1464146
  misc_feature: Encodes the peptide sequence at SEQ ID NO 644
atgtcgttgacggtgactagagaccagacatgctatctttcccgcgtccctgtttatgaagctgggaggtgtccggaccagcttgggcgtacctcgattaaatatacgggccttgaagtcaacgaccatgagcagaaacaaccttcatggatatatgaatataggcagaaggcccatgagtacaaaggaaaggccagagtccccatgagagtggagcctgtcgaaacctatttttcattgctgatcttgaaaaaaacatcattatcaacatgttatggaggaaggacggcggcggggttacagagctcagcgaagagagcgaggacaatgagcagcacttcggagtcttcctcctcctcctcctcctttaaggacgcgtttggaaattacgctaattatctcaataaacttaatgaaaaacgcgaaagagtggtaaaagcgagccgggatatcaccatgaacagcaaaaaggtcatatttcaagttcatagaatcagtaaggacaacagagacgaagttcttgacaaggcagaaaaggatttagctgctgtgacagaacagtatatcctcaagttggtgaaagaactgcaagggaccgatttctggaagctaagacgagcatactctcctggggttgtacaggaatacgttgaagcggcaacattctgtaaattctgcagaactgggactcttttaaatctggatgaaataaatgctactctgttgccgctaagtgaaccatccgttgagcctttgcaaataaatgtccttgactatttgctggggcttgcagatttgaccggagagctgatgcgattggcgattgggcgaatatcagatggcgagcttgaatatgccaagaagatatgtcagtttgttcatgatatctacagggagctgacccttattgtcccatatatggatgatagttctgacatgaaaacaaagatggatacaatgctccaaagcgtggtgaaaatagagaacgcttgctatggtgttcatgtgagaggatctgaatataccccgctgctgggagccagtgagccaagttcttttttgttggggacagtcatggtgttgcaaagaggcagacataatttgctggaccttaagggaaatagttccttgaagagtttgaaaggagctgcaaagttttccaattgtgcaacttatcgaatgggaacagcttgccctggtttacttgttaaacatcttctatgcacaatcgttctgggcttcaggtttaggcttacgcgcaccacgactattccccacggcccactggacatcctgcaagcccaggagcagagtagaccaatcattgtcaattacacctgtagctcaaggatcagaaaatggctaggaccacctgcactgtgccattgccaggatccatgtgaaagtgcacctaacctttatatgaattatcagggtgtgtttgtaaggagtggtccagacatgtattgcgatttcttagggtgtggacgagggatgaactgtgagaagcgaaggattggttgttcactttgtttaacagtcatggtgttgcaaagaggcagacataatttgctggaccttaagggaaatagttccttgaagagtttgaaaggagctgcaacttgccctggtttacttgttaaacatcttcttctatgcacgatcattctgggcttcagggacatatcatattaccatgtgcaagatgatacagaacccgctatacccacagctataaggattaagggcactttctacagccataaagggcacttcgtttatgagaggagaccattcactgtcaaatacagagcaactatgcttgctagtggttgtcgcttcctcaataccagcacccactggccacttaatgtaattgaaagcatttcttctcgagctacaatgccaaatcccgagcaatctctttctcttcccggatacttgcaagaaaacgtaacctcccaagaatttagagacttgatagtctccatacccactgagaaaggctggattgcaaatcatctccatcaataccaaggtttttggcacacaactaggcaacttcaaggggttctagcttgccaaaaacactttcaagcccaagatggcgatatctttcttgtcaccactcctaaatcaggctctacttggttaaaggcagtgatgtttgccttggtgaatcgggtttcctttcctgacactaaacaacaccctttgctcactaacaaccctcatgctcttttgcctttcttggagatggaatacattggcaaagagaatcttgacttcaccaactacacttttcctaggctgttttcaactcatctcccactcttgtcacttcccagatctgtggaggactctgattgcaagctagtttacttgtgtaggaatcctaaggacattttcgtgtccctttggcacttcactaacaagttgagacccattgattggggtgctagttcacttgaagagacctttgataaattttgtaggggagtgaatttgtacgggccattttgggaccatgttttgggttattggaaggagagcctggaaaggcctcatagggtatttttcttgaagtacgaggaaatgaaaaatgagcccaggattcaattgaggagactgtctgaattcttggggtgtccattttcccttgaagaagagaatagcggtgtcttggatgaaatcttggagctgtgtagttttgaaaacctgagcaatttagaagtgaataatatcggaaggctgcattccggagaggagcatcaggccttttttcgacgaggcgaagttggtgattccatgaattatctcacggctgagatggtggaaaaaattgacatgatcactgagcagaagttgcattgtcatggtttaaagttctag

SEQ ID NO: 644 - protein, 854 aa, Populus balsamifera subsp. trichocarpa
  misc_feature: Ceres ANNOT ID no.1464146
  misc_feature: Bit score of 439.9 for HMM based on sequences of FIGURE 4.
  misc_feature (593)..(851): Pfam Name: Sulfotransfer_1 Pfam Description: Sulfotransferase domain
  misc_feature: Functional Homolog Of Ceres SEEDLINE ID no. ME02549 at SEQ ID NO. 590
MSSTSESSSSSSSFKDAFGNYANYLNKLNEKRERVVKASRDITMNSKKVIFQVHRISKDNRDEVLDKAEKDLAAVTEQYILKLVKELQGTDFWKLRRAYSPGVVQEYVEAATFCKFCRTGTLLNLDEINATLLPLSEPSVEPLQINVLDYLLGLADLTGELMRLAIGRISDGELEYAKKICQFVHDIYRELTLIVPYMDDSSDMKTKMDTMLQSVVKIENACYGVHVRGSEYTPLLGASEPSSFLLGTVMVLQRGRHNLLDLKGNSSLKSLKGAAKFSNCATYRMGTACPGLLVKHLLCTIVLGFRFRLTRTTTIPHGPLDILQAQEQSRPIIVNYTCSSRIRKWLGPPALCHCQDPCESAPNLYMNYQGVFVRSGPDMYCDFLGCGRGMNCEKRRIGCSLCLTVMVLQRGRHNLLDLKGNSSLKSLKGAATCPGLLVKHLLLCTIILGFRDISYYHVQDDTEPAIPTAIRIKGTFYSHKGHFVYERRPFTVKYRATMLASGCRFLNTSTHWPLNVIESISSRATMPNPEQSLSLPGYLQENVTSQEFRDLIVSIPTEKGWIANHLHQYQGFWHTTRQLQGVLACQKHFQAQDGDIFLVTTPKSGSTWLKAVMFALVNRVSFPDTKQHPLLTNNPHALLPFLEMEYIGKENLDFTNYTFPRLFSTHLPLLSLPRSVEDSDCKLVYLCRNPKDIFVSLWHFTNKLRPIDWGASSLEETFDKFCRGVNLYGPFWDHVLGYWKESLERPHRVFFLKYEEMKNEPRIQLRRLSEFLGCPFSLEEENSGVLDEILELCSFENLSNLEVNNIGRLHSGEEHQAFFRRGEVGDSMNYLTAEMVEKIDMITEQKLHCHGLKF

SEQ ID NO: 645 - DNA, 978 bp, Populus balsamifera subsp. trichocarpa
  misc_feature: Ceres ANNOT ID no.1437744
  misc_feature: Encodes the peptide sequence at SEQ ID NO 646
atgcctccaatcacagaagaaaatctccaagaattgctcctcacccttcccagcgagaaaaacattgatggcacaaattctctctatctataccaaggggcttggattccaggttttaacttgagaggtgtggattcctttcaacgccgctttattgctcaagacaccgatataattgtggctagcatgccaaaatcaggcactacttggctgaaagccctagctttctcggttgcagaacgccacatctatggccccagagaaagtcctctactctcgacctcacctcatgaattagtacgtttcttcgagactgacctttactcgaaagaccagcccccagatcttgaacaacttcctcctccgaggattttcggttgtcactcccattacgcaaacttgccagagtccattcgagattccaagtgtaaagttgtgtacatatgtaggaatcctttggaccaaattgtctctttttttcagtttgcacacaagttcaaattagatgatggcacttctttattgtcactggatgaatgctacgagaacatttgtcgtggtgtccagagtcaaggccccttttgggataacgtgttggggtattggaaagcaagcttagaaagaccagacaaggtgttgttcttgaagtatgaggagctgaaagaggatatagtccttaacttgaagaaactggctgagttcttggggcttcccttcaccgacaaagaagaagaagaaggggttattgaagaaatatcaaggttgtgcagctttgacaatctcaggaatttggaagtgaacaaaaatggtgttcgtccattatctggggctccaaatagtgccttcttcaggaaaggagaggtgggcgattgggcaaattatctaagcccttccatggctgaaaaattcttcaatatagtagaagaaaagttggctggatctggtttatccttcaaaacatctcaggaaagtgcctag

SEQ ID NO: 646 - protein, 325 aa, Populus balsamifera subsp. trichocarpa
  misc_feature: Ceres ANNOT ID no.1437744
  misc_feature: Bit score of 483.7 for HMM based on sequences of FIGURE 4.
  misc_feature (55)..(315): Pfam Name: Sulfotransfer_1 Pfam Description: Sulfotransferase domain
  misc_feature: Functional Homolog Of Ceres SEEDLINE ID no. ME02549 at SEQ ID NO. 590
MPPITEENLQELLLTLPSEKNIDGTNSLYLYQGAWIPGFNLRGVDSFQRRFIAQDTDIIVASMPKSGTTWLKALAFSVAERHIYGPRESPLLSTSPHELVRFFETDLYSKDQPPDLEQLPPPRIFGCHSHYANLPESIRDSKCKVVYICRNPLDQIVSFFQFAHKFKLDDGTSLLSLDECYENICRGVQSQGPFWDNVLGYWKASLERPDKVLFLKYEELKEDIVLNLKKLAEFLGLPFTDKEEEEGVIEEISRLCSFDNLRNLEVNKNGVRPLSGAPNSAFFRKGEVGDWANYLSPSMAEKFFNIVEEKLAGSGLSFKTSQESA

SEQ ID NO: 647 - protein, 315 aa, Medicago truncatula
  misc_feature: Public GI ID no.92894684
  misc_feature: Bit score of 464.2 for HMM based on sequences of FIGURE 4.
  misc_feature (69)..(312): Pfam Name: Sulfotransfer_1 Pfam Description: Sulfotransferase domain
  misc_feature: Functional Homolog Of Ceres SEEDLINE ID no. ME02549 at SEQ ID NO. 590
MVKSSDENSFVAKYLQDDDLSQECKELIPTLPSEKAWILTHTYQYQGFWIATKKFQGVLSCQKHFQALDSDIILVTAPKSGTTWLKALTFALLNRNKYPIIHNNHPLLISNPHSLVPFLEIDLYSDKDYVPNLNSLSHPRLFSTHIPCALLPKSVKESTCKVVYLCRDPKDMFVSLYFGISQTRGVSSYGPFWEHVLGYWKENLERPEKVMFIKFEEMKMKPSFYLKKIAEFLGCPFFNEEESKGMIDDILNLCSFENLSNLEVNKTVRVATGVENKAFFRRGQVGDWKNLLTAEMIKQLNTITENKLGKHGLSF

SEQ ID NO: 648 - protein, 410 aa, Populus balsamifera subsp. trichocarpa
  misc_feature: Ceres ANNOT ID no.1509601
  misc_feature: Bit score of 634.2 for HMM based on sequences of FIGURE 9.
  misc_feature (117)..(343): Pfam Name: Trehalose_PPase Pfam Description: Trehalose-phosphatase
  misc_feature: Functional Homolog Of Ceres SEEDLINE ID no. ME20095 at SEQ ID NO. 1129
MTNQNVVVADTNSGLNLAITVHVTNSSIFTTAAQKPPAAPGGYISISRKKLLKNLEINGGARINAWVDSMRASSPTHIKSTPSVNEDQSSWILHHPSALEMFEQIIDASKGKQIVMFLDYDGTLSPIVDDPDKAFMSKQVMRATVRKLARFFPTAIVSGRCRDKVYNFVRLAELYYAGSHGMDIKGPAKGSKYKKAASEFLPMIDEVYEELVEKTKTTPGAKVENNKFCLSVHYRCVDEKKWSGLAQVVKSVLKEYPKLRLTQGRKVLEIRPTIKWDKGKALEFLLESLGFANCTDVFPVYIGDDRTDEDAFKVLRERGQGFGILVSKIPKDTSASYSLQEPTQATWHALAQTHLHVLGTSNRKQSPKFFTNDACKRKVLEPTVASFVNIPLLIISKATPARRLRKGGIV

SEQ ID NO: 649 - DNA, 1154 bp, Arabidopsis thaliana
  misc_feature: Ceres CLONE ID no.3964
  misc_feature: Encodes the peptide sequence at SEQ ID NO 650
aaagcatcaaataagtaaataaaaactcttttatgttcacctttttcactatcctctctttgtgtttcaaatcgtgggaacaaattatcacaatggaggcttctaaagaagctcatcaccttccaaactacatgaaagacgacaacgttagtcaagaaaccaagaacttgatcacttctctaccttcagacaaagatttcatgggttatggtctctacaactacaaaggttgttggtactatccaaacacactccaagccgttcttgacgtccaaaaacacttcaagccacgagatactgatataatcctcgcttctttgcccaaaggtggaaccacttggctcaaatccctaattttcgctgttgtacatagagaaaagtaccgcggaacccctcaaacacatcctttgctcttacaaaaccctcatgaccttgtcccatttcttgaggttgagttatacgctaatagccaaattccggatctcgcaaagtattcttctcctatgatcttttctacacacatgcacttacaagcattgcgtgaagccaccacaaaagcttgcaaaaccgtatatgtgtgtagaggtatcaaagatacgtttgtctccggctggcattatagaaacatgttgcatcgcaccaagatggatcaagccacttttgagctcatgtttgatgcttattgtagaggagttctcttatatggaccttattgggaacatgtattgagctattggaaagggagcttggaagcaaaggagaatgttcttttcatgaagtacgaagagataattgaggagcctcgtgttcaagtcaagagactcgccgagttcttggaatgtccattcaccaaggaagaagaagaaagtggatcggtggaggagatcttgaagttgtgtagtttacgaaatttaagcaatttggaggttaataagaatgggacaacgagaattggtgtagattctcaggtgttctttaggaaaggtgaagttggtgattggaagaatcatcttacgccacaaatggcgaaaacctttgatgagattattgactatagactaggagactccggtttgatatttcaataaggttgtgttgtgttttttttcttttgtcatccgaaaataaattaggactcaaacgagtcattcttg

SEQ ID NO: 650 - protein, 351 aa, Arabidopsis thaliana
  misc_feature: Ceres CLONE ID no.3964
  misc_feature: Bit score of 390.0 for HMM based on sequences of FIGURE 4.
  misc_feature (88)..(347): Pfam Name: Sulfotransfer_1 Pfam Description: Sulfotransferase domain
  misc_feature: Functional Homolog Of Ceres SEEDLINE ID no. ME02549 at SEQ ID NO. 590
MFTFFTILSLCFKSWEQIITMEASKEAHHLPNYMKDDNVSQETKNLITSLPSDKDFMGYGLYNYKGCWYYPNTLQAVLDVQKHFKPRDTDIILASLPKGGTTWLKSLIFAVVHREKYRGTPQTHPLLLQNPHDLVPFLEVELYANSQIPDLAKYSSPMIFSTHMHLQALREATTKACKTVYVCRGIKDTFVSGWHYRNMLHRTKMDQATFELMFDAYCRGVLLYGPYWEHVLSYWKGSLEAKENVLFMKYEEIIEEPRVQVKRLAEFLECPFTKEEEESGSVEEILKLCSLRNLSNLEVNKNGTTRIGVDSQVFFRKGEVGDWKNHLTPQMAKTFDEIIDYRLGDSGLIFQ

SEQ ID NO: 651 - protein, 331 aa, Arabidopsis thaliana
  misc_feature: Public GI ID no.13272389
  misc_feature: Bit score of 390.0 for HMM based on sequences of FIGURE 4.
  misc_feature (68)..(327): Pfam Name: Sulfotransfer_1 Pfam Description: Sulfotransferase domain
  misc_feature: Functional Homolog Of Ceres SEEDLINE ID no. ME02549 at SEQ ID NO. 590
MEASKEAHHLPNYMKDDNVSQETKNLITSLPSDKDFMGYGLYNYKGCWYYPNTLQAVLDVQKHFKPRDTDIILASLPKGGTTWLKSLIFAVVHREKYRGTPQTHPLLLQNPHDLVPFLEVELYANSQIPDLAKYSSPMIFSTHMHLQALREATTKACKTVYVCRGIKDTFVSGWHYRNMLHRTKMDQATFELMFDAYCRGVLLYGPYWEHVLSYWKGSLEAKENVLFMKYEEIIEEPRVQVKRLAEFLECPFTKEEEESGSVEEILKLCSLRNLSNLEVNKNGTTRIGVDSQVFFRKGEVGDWKNHLTPQMAKTFDEIIDYRLGDSGLIFQ

SEQ ID NO: 652 - DNA, 1191 bp, Populus balsamifera subsp. trichocarpa
  misc_feature: Ceres ANNOT ID no.1481203
  misc_feature: Encodes the peptide sequence at SEQ ID NO 653
atgtccattgcaagactcgatcgagcaagctcggaaacacaatatccaaaacgatcattagccgtttatgggagatgcacagacacttctcatgtgtatagtgtcctggggttggaaagcatgccgactgaattttttggaagccaacttgaggtcgaaacttggcaagcatttgtgattcttagtttgatggagtgtgtggaaatcactgtagaggaagagcagagagatgaaagtacccaggagttgcttcaacacctcccaacagaaataggtatgggaggcaatcttctctatctataccaaggattctggtgtccacaggtatcaatcaagggcatgatgttgtttcaacaacacttcaaggcacaagaaactgacctcatacttgccagcattccaaaatcaggtacaacttggttaaaggccttgatttatactatagttaatcgctcccatcactctcttgaaaagagccctttgctcaccaatggccctcatggggtggtgccctttcttgagtttgatatcagctccaaaaaccagtttctggaacaagacaagcttcccgagcctaggattttcggaacccactcaccttacacggcactcccgtgttcggtcaaagattctgctgctaagattgtgtatgtgtgtcggaatcctctggacatgttcatttcctattggaaattcagtgtcaatatcccgaaggagaatgagaaacacctttcactaggagacgcttttgacaagttctgtcagggacttcatggctacggtccattttgggatcatttattagggtattggaaggcaagcttggagagacctgataaggtcttgtttctgaaatacgaggacattaaaaagaacaatgtccctagcatcaagaagctggctacctttctggggcttcctttctctgtggaggaagagaagcaaggtttgatagaggaaacatcaaggctatgcagcgttgaaagcatgaaaaaccatgaagcaaccatgacaggcacaggccctcttgggatcccagctagtgccttcctcaggaaaggaaaggtgggagattcactgaattatctaacaccctcaatggtgagccgtgtggagaatctgattcaagagaagctccaagattctggtctctgcttctgtctgtctagcactttccaaaatagtgcttga

SEQ ID NO: 653 - protein, 333 aa, Populus balsamifera subsp. trichocarpa
  misc_feature: Ceres ANNOT ID no.1481203
  misc_feature: Bit score of 476.0 for HMM based on sequences of FIGURE 4.
  misc_feature (62)..(320): Pfam Name: Sulfotransfer_1 Pfam Description: Sulfotransferase domain
  misc_feature: Functional Homolog Of Ceres SEEDLINE ID no. ME02549 at SEQ ID NO. 590
MECVEITVEEEQRDESTQELLQHLPTEIGMGGNLLYLYQGFWCPQVSIKGMMLFQQHFKAQETDLILASIPKSGTTWLKALIYTIVNRSHHSLEKSPLLTNGPHGVVPFLEFDISSKNQFLEQDKLPEPRIFGTHSPYTALPCSVKDSAAKIVYVCRNPLDMFISYWKFSVNIPKENEKHLSLGDAFDKFCQGLHGYGPFWDHLLGYWKASLERPDKVLFLKYEDIKKNNVPSIKKLATFLGLPFSVEEEKQGLIEETSRLCSVESMKNHEATMTGTGPLGIPASAFLRKGKVGDSLNYLTPSMVSRVENLIQEKLQDSGLCFCLSSTFQNSA

SEQ ID NO: 654 - protein, 326 aa, Arabidopsis thaliana
  misc_feature: Public GI ID no.15227699
  misc_feature: Bit score of 411.0 for HMM based on sequences of FIGURE 4.
  misc_feature (65)..(321): Pfam Name: Sulfotransfer_1 Pfam Description: Sulfotransferase domain
  misc_feature: Functional Homolog Of Ceres SEEDLINE ID no. ME02549 at SEQ ID NO. 590
MSSSSSVPAYLGDEDLTQETRALISSLPKEKGWLVSEIYEFQGLWHTQAILQGILICQKRFEAKDSDIILVTNPKSGTTWLKALVFALLNRHKFPVSSSGNHPLLVTNPHLLVPFLEGVYYESPDFDFSSLPSPRLMNTHISHLSLPESVKSSSCKIVYCCRNPKDMFVSLWHFGKKLAPEETADYPIEKAVEAFCEGKFIGGPFWDHILEYWYASRENPNKVLFVTYEELKKQTEVEMKRIAEFLECGFIEEEEVREIVKLCSFESLSNLEVNKEGKLPNGIETKTFFRKGEIGGWRDTLSESLAEEIDRTIEEKFKGSGLKFSS

SEQ ID NO: 655 - protein, 316 aa, Medicago truncatula
  misc_feature: Public GI ID no.92886084
  misc_feature: Bit score of 557.9 for HMM based on sequences of FIGURE 4.
  misc_feature (45)..(309): Pfam Name: Sulfotransfer_1 Pfam Description: Sulfotransferase domain
  misc_feature: Functional Homolog Of Ceres SEEDLINE ID no. ME02549 at SEQ ID NO. 590
MASKDLTNFTEYQSKDVQLEAFGEEDSKCKELILSLPKEYYGPKDSDVVVASMPKTGTTWLKALTFAIVNRNRFSSLENHPLLTSNSHELVPSLESNVYVDTISQFPKFDILNMIEPRLFGTHIPFASLAKSIKESNCKIIYICRNPFDTYVSYWNFMNKISLNFDFPTITIEDDFERYCKGICHVGSFWDHVLGYLNESIARPDKVLFMKYEDLKENGNSHVKRIAEFLDCPFTQEEESNGVIENIINLCSFKKMKELEANKFGEFGRKIEKNYLFRKAEVGDWINYLSPSMVEKLSKIIEEKFSGSGLSFKVCT

SEQ ID NO: 656 - protein, 331 aa, Arabidopsis thaliana
  misc_feature: Public GI ID no.15239947
  misc_feature: Bit score of 392.3 for HMM based on sequences of FIGURE 4.
  misc_feature (64)..(328): Pfam Name: Sulfotransfer_1 Pfam Description: Sulfotransferase domain
  misc_feature: Functional Homolog Of Ceres SEEDLINE ID no. ME02549 at SEQ ID NO. 590
MAGKSDLPVIARDDNLSEETKTLISSLPTYQDSHVKLCKYQGCWYYHNTLQAVINYQRNFQPQDTDIILASFPKSGTTWLKALSVAIVERSKQPFDDDPLTHPLLSDNPHGIVPFFEFDMYLKTSTPDLTKFSTSSPRLFSTHMPLHTFKEGLKGSPCKVVYMCRNIKDVLISDWHFRSKYSNNEVSRSTLESMFESFCGGVSFYGPFWDHALSYWRGSLENPKHVLFMRYEEMKTEPCVQVKRLAEFLGFPFTKEEEDSGSISKLLELCSLGNLSGLEVNKTGKTWMNYDYKSYFRKGEVGDWKNHLTPEMENKIDMIIEEKLKGSDLKF

SEQ ID NO: 657 - DNA, 1207 bp, Arabidopsis thaliana
  misc_feature: Ceres CLONE ID no.34878
  misc_feature: Encodes the peptide sequence at SEQ ID NO 658
acaacactcgacacagaagcaaaaacaaaaatgggtgagaaagatattccaaggaacttgaaggaagaagaagaaaaccaaagtgaagattccaaaagtttgatctcttcacttccttcagacatagattgctctgggaccaagttgtacaagtatcaaggatgttggtacgataaagacattctccaagcaatcctcaaattcaacaaaatctttcagccacaagaaaccgatataattgttgcttctttccccaaatcaggtacgacttggctcaaggcactcacattcgcactcgctcaaagatcaaaacatacttcagaaaatcatcctctgctaactcataatcctcatgagctagtgccgtacctcgagctcgatctttatctcaaaagctcgaaaccggatatgtccaagttaccatcatcatctccgagattgttctcaacccacatgtctttcgatgcgcttaaagtaccaatgaaggagactccttgcaagatagtgtatgtgtgcaggaacgtaaaagacgtgttggtatcactttggtgtttcgaaaactccattagtggagaaaacaatttaagtctcgaggctttgttcgagtctttatgtagcggagttaacttatgcggtcccttgtgggaaaatgtgttaggctattggagaggaagcttggaagatcctaagcatgtgcttttcttgaggtacgaggagttgaagacggagcctcgtgtgcaaatcaagagacttgcagagttcttagattttccattcacaaaggaagaagaagatagtggaggtgtagacaagatcttggaactttgttctctaagaaaccttagcggtttggagatcaacaaaacaggaagcttgtcggaaggagtaagtttcaagagttttttccgtaaaggggaagttggtgattggaagagttatatgactcctgaaatggaaaacaaaatcgacatgattgttgaggagaaacttcaaggctctggtttgatattgtagagttcatatctctatgtatatgtgaacaggtttaatctcaaacctaataatgctggtttgttcttttcttgtatgcaatgtaataaaagttactttgatgtaaggttaagagtttaagattctgagcgatgtgtcgtttttgtttcctttgataatcaataaagctagcggcttttcttcttcgccaaggcat

SEQ ID NO: 658 - protein, 327 aa, Arabidopsis thaliana
  misc_feature: Ceres CLONE ID no.34878
  misc_feature: Bit score of 428.2 for HMM based on sequences of FIGURE 4.
  misc_feature (66)..(324): Pfam Name: Sulfotransfer_1 Pfam Description: Sulfotransferase domain
  misc_feature: Functional Homolog Of Ceres SEEDLINE ID no. ME02549 at SEQ ID NO. 590
MGEKDIPRNLKEEEENQSEDSKSLISSLPSDIDCSGTKLYKYQGCWYDKDILQAILKFNKIFQPQETDIIVASFPKSGTTWLKALTFALAQRSKHTSENHPLLTHNPHELVPYLELDLYLKSSKPDMSKLPSSSPRLFSTHMSFDALKVPMKETPCKIVYVCRNVKDVLVSLWCFENSISGENNLSLEALFESLCSGVNLCGPLWENVLGYWRGSLEDPKHVLFLRYEELKTEPRVQIKRLAEFLDFPFTKEEEDSGGVDKILELCSLRNLSGLEINKTGSLSEGVSFKSFFRKGEVGDWKSYMTPEMENKIDMIVEEKLQGSGLIL

SEQ ID NO: 659 - DNA, 1212 bp, Arabidopsis thaliana
  misc_feature: Ceres CLONE ID no.150484
  misc_feature: Encodes the peptide sequence at SEQ ID NO 660
acaacactcgacacaaaagcaaaaacaaaaatgggtgagaaagatattccaaggaacttgaaggaagaagaagaagaagaagaagaaaaccaaagtgaagaaaccaaaagtttgatctcttcacttccttcagacatagattgctcagggaccaagttgtacaagtaccaaggatgttggtacgacaaagatattctccaagcaatcctcaatttcaacaaaaactttcagccacaagaaacggatataattgttgcttctttccccaaatcgggtacgacttggctcaaggcactcacattcgcactcgcgcaaagatcaaaacacacttcagacaatcatcctctgctaactcataatcctcatgagctagtgccgtacctcgagctcgatctttatctcaaaagctcgaaaccggatttgaccaagttgccatcatcatctccgagattgttctcaacccacatgtcctttgatgcgcttaaagtaccgttgaaagagtctccttgcaagatcgtgtacgtgtgcaggaacgtgaatgacgtattgatatcactttggtgtttcgaaaactccatgagtggagaaaacaatttaagtctcgaggctttgttcgagtctttatgtagcggagttaacttatgcggtcccttatgggaaaatgtgttaggctattggagaggaagcttggaagatcctaagcatgtgcttttcttgaggtacgaggagttgaagacggagcctcgtgtgcaaatcaagagacttgcagagttcttagattgtccattcacaaaggaagaagaagatagtggaggtgtagacaagatcttggaactttgttctctaagaaaccttagcggtttggagatcaacaaaacaggaagcttgtcggaaggagtaagtttcaagagttttttccgtaaaggggaagttggtgattggaagagttatatgactcctgaaatggaaaacaaaatcgacatgattgttgaggagaaacttcaaggctctggtttgaaattgtagagttcatatctctatgtatatgtgtgggaacaggtttaatctcaaacctaataatgctggtttgttcttttcttgtatgcaatgtaataaaagttactttgatgtaaggttaagagtttaagattcttagtgatgtgttgttgtttttgtttcgtttgataacgaataaagctagcggcttttctc

SEQ ID NO: 660 - protein, 331 aa, Arabidopsis thaliana
  misc_feature: Ceres CLONE ID no.150484
  misc_feature: Bit score of 451.9 for HMM based on sequences of FIGURE 4.
  misc_feature (70)..(328): Pfam Name: Sulfotransfer_1 Pfam Description: Sulfotransferase domain
  misc_feature: Functional Homolog Of Ceres SEEDLINE ID no. ME02549 at SEQ ID NO. 590
MGEKDIPRNLKEEEEEEEENQSEETKSLISSLPSDIDCSGTKLYKYQGCWYDKDILQAILNFNKNFQPQETDIIVASFPKSGTTWLKALTFALAQRSKHTSDNHPLLTHNPHELVPYLELDLYLKSSKPDLTKLPSSSPRLFSTHMSFDALKVPLKESPCKIVYVCRNVNDVLISLWCFENSMSGENNLSLEALFESLCSGVNLCGPLWENVLGYWRGSLEDPKHVLFLRYEELKTEPRVQIKRLAEFLDCPFTKEEEDSGGVDKILELCSLRNLSGLEINKTGSLSEGVSFKSFFRKGEVGDWKSYMTPEMENKIDMIVEEKLQGSGLKL

SEQ ID NO: 661 - protein, 331 aa, Arabidopsis thaliana; identical to SEQ ID NO: 660
  misc_feature: Public GI ID no.21553545
  misc_feature: Bit score of 451.9 for HMM based on sequences of FIGURE 4.
  misc_feature (70)..(328): Pfam Name: Sulfotransfer_1 Pfam Description: Sulfotransferase domain
  misc_feature: Functional Homolog Of Ceres SEEDLINE ID no. ME02549 at SEQ ID NO. 590

SEQ ID NO: 662 - protein, 331 aa, Arabidopsis thaliana
  misc_feature: Public GI ID no.15222843
  misc_feature: Bit score of 455.9 for HMM based on sequences of FIGURE 4.
  misc_feature (70)..(328): Pfam Name: Sulfotransfer_1 Pfam Description: Sulfotransferase domain
  misc_feature: Functional Homolog Of Ceres SEEDLINE ID no. ME02549 at SEQ ID NO. 590
MGEKDIPRNLKEEEEEEEENQSEETKSLISSLPSDIDCSGTKLYKYQGCWYDKDILQAILNFNKNFQPQETDIIVASFPKSGTTWLKALTFALAQRSKHTSDNHPLLTHNPHELVPYLELDLYLKSSKPDLTKLPSSSPRLFSTHMSFDALKVPLKESPCKIVYVCRNVKDVLVSLWCFENSMSGENNLSLEALFESLCSGVNLCGPLWENVLGYWRGSLEDPKHVLFLRYEELKTEPRVQIKRLAEFLDCPFTKEEEDSGGVDKILELCSLRNLSGLEINKTGSLSEGVSFKSFFRKGEVGDWKSYMTPEMENKIDMIVEEKLQGSGLKL

SEQ ID NO: 663 - protein, 323 aa, Brassica napus
  misc_feature: Public GI ID no.38230552
  misc_feature: Bit score of 398.1 for HMM based on sequences of FIGURE 4.
  misc_feature (63)..(318): Pfam Name: Sulfotransfer_1 Pfam Description: Sulfotransferase domain
  misc_feature: Functional Homolog Of Ceres SEEDLINE ID no. ME02549 at SEQ ID NO. 590
MSSSSSSYLRDEDLTQETRDLISSLPSEKGWLVSQMYQFQGRWHTQALLQGLLQYQKHFEAKDSDIILVTNPKSGTTWLKALVFSLINRHKFPVSSGDHPLLVTNPHLLIPFLEGVYYESPNFDFTELPSPRLMNTHISLLSLPESVKSSSCKIVYCCRNPKDMFVSLWHFGKKLASQETADYPIEKAVEAFCQGKFIGGPFWDHVLEYWYASLENPNKVLFVTYEELKKQTGDTIKRIAEFLGCGFIEEEEVGGIVKLCSFESLSSLEANREGKLPNGVETKAFFRKGEVGGWRDTLSESLAEEIDRTMEEKFQGSGLKFSC

SEQ ID NO: 664 - protein, 325 aa, Brassica napus
  misc_feature: Public GI ID no.3420008
  misc_feature: Bit score of 407.1 for HMM based on sequences of FIGURE 4.
  misc_feature (65)..(320): Pfam Name: Sulfotransfer_1 Pfam Description: Sulfotransferase domain
  misc_feature: Functional Homolog Of Ceres SEEDLINE ID no. ME02549 at SEQ ID NO. 590
MSSSSSVPDYLRDEKLTQETRDLISSLPSEKGWLVSQIYQFQGRWHTEALLQGILTCQKHFKAKDSDIILVTNPKSGTTWLKSLVFALINRHKFPVSSGDHPLLVTNPHLLVPFMEGVYYESPDFDFSLLPFPRLMNTHISHLSLPESVKSSSCQIVYCCRNPKDMFVSLWHFGKKLAPQETADYPLEKAVEAFCQGKFIAGPFWDHVLEYWYASLENPNKVLFVTYEELKKQTEVEVKRIAEFIGCGFTAEEEVSEIVKLCSFESLSRLEVNRQGKLPNGIETNAFFRKGEIGGWRDTLSESLADAIDRTTEEKFGGSGLKFSC

SEQ ID NO: 665 - protein, 323 aa, Arabidopsis thaliana
  misc_feature: Public GI ID no.15230602
  misc_feature: Bit score of 438.5 for HMM based on sequences of FIGURE 4.
  misc_feature (59)..(320): Pfam Name: Sulfotransfer_1 Pfam Description: Sulfotransferase domain
  misc_feature: Functional Homolog Of Ceres SEEDLINE ID no. ME02549 at SEQ ID NO. 590
MEMNLRIEDLNEETKTLISSLPSDKDFTGKTICKYQGCWYTHNVLQAVLNFQKSFKPQDTDIIVASFPKCGTTWLKALTFALLHRSKQPSHDDDHPLLSNNPHVLVPYFEIDLYLRSENPDLTKFSSSPRLFSTHVPSHTLQEGLKGSTCKIVYISRNVKDTLVSYWHFFTKKQTDEKIISSFEDTFEMFCRGVSIFGPFWDHVLSYWRGSLEDPNHVLFMKFEEMKAEPRDQIKKFAEFLGCPFTKEEEESGSVDEIIDLCSLRNLSSLEINKTGKLNSGRENKMFFRKGEVGDWKNYLTPEMENKIDMIIQEKLQNSGLKF

SEQ ID NO: 666 - protein, 323 aa, Brassica napus
  misc_feature: Public GI ID no.3420004
  misc_feature: Bit score of 385.5 for HMM based on sequences of FIGURE 4.
  misc_feature (64)..(318): Pfam Name: Sulfotransfer_1 Pfam Description: Sulfotransferase domain
  misc_feature: Functional Homolog Of Ceres SEEDLINE ID no. ME02549 at SEQ ID NO. 590
MESSSVPVYLKDENLTQETRDLLSSLPSEKGWLVSQMYQFEGIWQTQALVQGIVNCQKHFEANDSDVILATLAKSGTTWLKALLFALIHRHKFPVSGKHPLLVTNPHSLVPYLEGDYCSSPEVNFAELPSPRLMQTHLTHHSLPVSIKSSSCKIIYCCRNPKDMFVSIWHFGRKLAPEKTAEYPIETAVAAFCKGKFIGGPFWDHVLEYWYESLKNPNKVLFVTYEELKKQTEVEVKRIAEFIGCGFTAEEEVSEIVKLCSFESLSSLEVNRQGKLPNGIESNAFFRKGETGGWRDTLSESLADVIDRTTEQKFGGSGLKFSS

SEQ ID NO: 667 - protein, 302 aa, Arabidopsis thaliana
  misc_feature: Public GI ID no.2129586
  misc_feature: Bit score of 339.7 for HMM based on sequences of FIGURE 4.
  misc_feature (65)..(301): Pfam Name: Sulfotransfer_1 Pfam Description: Sulfotransferase domain
  misc_feature: Functional Homolog Of Ceres SEEDLINE ID no. ME02549 at SEQ ID NO. 590
MSSSSSVPAYLGDEDLTQETRALISSLPKEKGWLVSEIYEFQGLWHTQAILQGILICQKRFEAKDSDIILVTNPKSGTTWLKALVFALLNRHKFPVSSSGNHPLLVTNPHLLVPFLEGVYYESPDFDFSSLPSPRLMNTHISHLSLPESVKSSSCKIVYCCRNPKDMFVSLWHFGKKLAPEETADYPIEKAVEAFCEGKFIGGPFWDHILEYWYASRENPNKVLFVTYEELKKQTEVEMKRIAEFLECGFIEEEEVREIVKLCSFESLSNLEVNKEGKLPNGIETKTFFRKGEIGGWRDSFE

SEQ ID NO: 668 - protein, 326 aa, Arabidopsis thaliana
  misc_feature: Public GI ID no.15217849
  misc_feature: Bit score of 370.9 for HMM based on sequences of FIGURE 4.
  misc_feature (62)..(323): Pfam Name: Sulfotransfer_1 Pfam Description: Sulfotransferase domain
  misc_feature: Functional Homolog Of Ceres SEEDLINE ID no. ME02549 at SEQ ID NO. 590
MDETKIPKKLQSDDEENISLISSLPFDVDFDSTKLFKYQGCWYDDKTLQGVLNFQRGFEPQDTDIIIASFPKSGTTWLKALTVALLERSKQKHSSDDHPLLLDNPHGLVPFLELRLFTETSKPDLTSISSSPRLFSTHVAFQTLREALKNSPCKIVYVWRNVKDVLVSFWYFNSAKLKIEEERSILDSMFESFCRGVINYGPSWEHVLNYWRASLEDSKNVLFLKYEELKTEPRVQLKRLAEFLDCPFTVEEEERGSVEEILDLCSLRNLKNLEINKTGKTLRGADHKIFFRKGEVGDSKNHLTPEMEKIIDMITEEKFEGSDLKF

SEQ ID NO: 669 - protein, 324 aa, Arabidopsis thaliana
  misc_feature: Public GI ID no.15227704
  misc_feature: Bit score of 395.0 for HMM based on sequences of FIGURE 4.
  misc_feature (66)..(319): Pfam Name: Sulfotransfer_1 Pfam Description: Sulfotransferase domain
  misc_feature: Functional Homolog Of Ceres SEEDLINE ID no. ME02549 at SEQ ID NO. 590
MTKSETTLSKLLVESELVQECEELLSSLPRDRSVFAEYLYQYQGFWYPPNLLEGVLYSQKHFQARDSDIVLASIPKSGTTWLKSLVFALIHRQEFQTPLVSHPLLDNNPHTLVTFIEGFHLHTQDTSPRIFSTHIPVGSLPESVKDSSCKVVYCCRNPKDAFVSLWHFMKNLIVKEMVGCTMEEMVRFFCRGSSIYGPFWDHVLQYWKESRENPKKVMFVMYEEMREQPQEWVMRIAEFLGYSFTEEEIENGVLEDIIKLCSLENLSKLEVNEKGKLLNGMETKAFFRKGEIGGWRDTLTPLLAEEIDKTTKEKLIGSDFRFFC

SEQ ID NO: 670 - DNA, 1479 bp, Populus balsamifera subsp. trichocarpa
  misc_feature: Ceres ANNOT ID no.1465750
  misc_feature: Encodes the peptide sequence at SEQ ID NO 671
atggaatcctctttgccttccacccaaatcttggattctggtgacagtgcagagaggaaaaatgaagctaaaaattacaatgaagtgatgtccacctttccgaaagttaaaggcttgaatgggtatgattattacctgtaccaaggcttttggtacgctcccttcttcttggaaggactcatgtctgttcaagagggcttcaatcctcaatccactgatatatttgtcgccagttttccaaaaactggcacaacttggcttaaggccctcacttttgctattgtcacacgatcccgtttaagtggttcaacaactagttctttacttaccaagatgccacatgactgtgttccttttttggaatatgaccttgctcaaaaccccagtaatcgggacttggcaattcctctggtatctactcatgttccttacacttgtttacctaaatctatcatttcttctagttgcaagattatttacatttgcagggacgcaaaggatgcttttgtttctttgtggtactttcttgccaggctgcaaatgtcgaaaaatgttgaacctcttcctctggaaggggcatttgagttgttttgcaatggaattgcaaattttggaccatattgggaccatgttttagggtattggagagcaagcttcgagttccctgagaagatattgttcttgacatatgaggaaatgaagcaagacacagctgctcatgttaagaaattagctgagttcatgggttgttctttcaccttagaggaagaggagggaggggaggtgcaaaagataataagcatgtgtagttttgagaagttgagcagcttggaggtcaataaaaatgggaagcaccgtccggacacatcacttgctattcaaaacagtgtatacttcaggagaggtgagataggcgactgggcaaatcacttgacacctgaaatgggagcacgtctagatgacataatggagcagaaactcaagggttcaggcttgaagctgcccagggaaaaaatgacagaaagtgagttgcagggaatgaaaaaggcattagtaaactcaacacctttcaggagaatgagaaagcacaaactctttaagagaagatattctccggcaatggcatcaaacagaaaagtccgacgtcaactaaccactgctttttctcttctccttctcttctcgttctccttcgtcttctgcattctctactgttcacgtgaacaatggagagtggagagcagctcaccatcaacccctgctgtttccaccgccagccactgctcttcctcttccccttctccttcgtcttttacgttctccactgttaatgtgaacagtggagagcagctcaccaccggccttcactatttccactgccagccactgctcttcctcttccccttccccttctccttccccttctccttctcattcatcttctgcattctccactgttcatggccggactgggcctag

SEQ ID NO: 671 - protein, 492 aa, Populus balsamifera subsp. trichocarpa
  misc_feature: Ceres ANNOT ID no.1465750
  misc_feature: Bit score of 435.5 for HMM based on sequences of FIGURE 4.
  misc_feature (71)..(331): Pfam Name: Sulfotransfer_1 Pfam Description: Sulfotransferase domain
  misc_feature: Functional Homolog Of Ceres SEEDLINE ID no. ME02549 at SEQ ID NO. 590
MESSLPSTQILDSGDSAERKNEAKNYNEVMSTFPKVKGLNGYDYYLYQGFWYAPFFLEGLMSVQEGFNPQSTDIFVASFPKTGTTWLKALTFAIVTRSRLSGSTTSSLLTKMPHDCVPFLEYDLAQNPSNRDLAIPLVSTHVPYTCLPKSIISSSCKIIYICRDAKDAFVSLWYFLARLQMSKNVEPLPLEGAFELFCNGIANFGPYWDHVLGYWRASFEFPEKILFLTYEEMKQDTAAHVKKLAEFMGCSFTLEEEEGGEVQKIISMCSFEKLSSLEVNKNGKHRPDTSLAIQNSVYFRRGEIGDWANHLTPEMGARLDDIMEQKLKGSGLKLPREKMTESELQGMKKALVNSTPFRRMRKHKLFKRRYSPAMASNRKVRRQLTTAFSLLLLFSFSFVFCILYCSREQWRVESSSPSTPAVSTASHCSSSSPSPSSFTFSTVNVNSGEQLTTGLHYFHCQPLLFLFPFPFSFPFSFSFIFCILHCSWPDWA

SEQ ID NO: 672 - DNA, 1153 bp, Gossypium hirsutum
  misc_feature: Ceres CLONE ID no.1983975
  misc_feature: Encodes the peptide sequence at SEQ ID NO 673
gcagacattgaagagctctcctctgctgaggcgattgaaagagtggtggagttcatgtcaacactcccaacagaaaatgggtggaattctttccagcctcttcgcttatacgaaggcttttggaccttccctcatttcctcgaaagcatcatattagctcaacaccgcttcaagcctaaaccaggcgatatcttcctctgtagcgctccgaaaagtggaactacatggctcaaagcactgagtttcgccatcgtcactcgaaacctttacgacacctccaatagtccattacttaccaagggtcctcatcattgtgtcccaaatatggtcgggtttgaatataaaccagacgtccgtcaaccaggtatcccactcatacccacccatgcaccttaccattgtttgcccaaatctgttttgggttccgatgatgttaaagttgtttacatttgtcgggacccgaaagatgcgttcgtttccatgtttcactttgcagccaaccgaaggcctaaggaaaacgaacacattgcgatagaggaggcttttgagcttttctgtctagggaggtctgtttttggaccggcttgggatcatattctgggttattggaaagctagtcaagaacgaccggaaaaggtaatgtttttgaaatacgaagaattgatgaatgatagtgagttgtatgtgaaaaaattggctgagtttatagggtacccttttagctttgaagaagaacaaggtggggtagtgaagaaactaatagatttatgcagttttgagaacttgagtaatttagacgtgaacaagacgggaaaacgacatgaagacgacgatgaggcaacgaacaagacgttcttcagaaaaggcaaggttggggattggcaaaaccatcttacacccgagatggctaatcggctcgacaatatagtggagcaaaaactgagtggaaccggtttgagtttcgaactcaacaatggatcatcttgatggactaaaatcatttgtctttcgggtaataattgtgtgttcatttgcaactgtgtttggttgggatgctttgaatttcttgttcaaagatccaaacatgttattgaaacctatttctctctgttattgagattcatgtttggaataaaaaaaaaaaaaaaaaaaa

SEQ ID NO: 673 - protein, 310 aa, Gossypium hirsutum
  misc_feature: Ceres CLONE ID no.1983975
  misc_feature: Bit score of 361.7 for HMM based on sequences of FIGURE 4.
  misc_feature (43)..(300): Pfam Name: Sulfotransfer_1 Pfam Description: Sulfotransferase domain
  misc_feature: Functional Homolog Of Ceres SEEDLINE ID no. ME02549 at SEQ ID NO. 590
MSTLPTENGWNSFQPLRLYEGFWTFPHFLESIILAQHRFKPKPGDIFLCSAPKSGTTWLKALSFAIVTRNLYDTSNSPLLTKGPHHCVPNMVGFEYKPDVRQPGIPLIPTHAPYHCLPKSVLGSDDVKVVYICRDPKDAFVSMFHFAANRRPKENEHIAIEEAFELFCLGRSVFGPAWDHILGYWKASQERPEKVMFLKYEELMNDSELYVKKLAEFIGYPFSFEEEQGGVVKKLIDLCSFENLSNLDVNKTGKRHEDDDEATNKTFFRKGKVGDWQNHLTPEMANRLDNIVEQKLSGTGLSFELNNGSS

SEQ ID NO: 674 - protein, 332 aa, Oryza sativa subsp. japonica
  misc_feature: Public GI ID no.115477272
  misc_feature: Bit score of 799.4 for HMM based on sequences of FIGURE 4.
  misc_feature (66)..(329): Pfam Name: Sulfotransfer_1 Pfam Description: Sulfotransferase domain
  misc_feature: Functional Homolog Of Ceres SEEDLINE ID no. ME02549 at SEQ ID NO. 590
MAEGRQLEAQSVVVPTATGDKGDDILSSLPTREGWWTTFVLYDGCWMDRQAAMSVSLVRAQFVPRDDDVLLATYPKCGTTWLKALSFAIANRHRHPVVSAGHHPLLTQSPHDLVPFIELPFRHIHPLAAALDAIPSPRLLGTHMPHHLLPPRIGCRIVYLCREPKDVVISTWHFMNKVIEGFSIDFDKAFELFVDGCSPFGPIWNHYLGYWNKHVEEPDRVLFLKYDDMMADPAGHVKKLAEFLRVPFTDDEVDAGVVEEVVRLCSFEKLSRLPVNSSVVAGRVGVDERPMKNSVFFRKGKVRDWKNYLTEEMAKKLDAAIEEKLKGSGLTL

SEQ ID NO: 675 - protein, 333 aa, Arabidopsis thaliana
  misc_feature: Public GI ID no.15226028
  misc_feature: Bit score of 347.4 for HMM based on sequences of FIGURE 4.
  misc_feature (66)..(330): Pfam Name: Sulfotransfer_1 Pfam Description: Sulfotransferase domain
  misc_feature: Functional Homolog Of Ceres SEEDLINE ID no. ME02549 at SEQ ID NO. 590
MDEKDRPKNLREEEEKPSEETKILISSLPWEIDYLGNKLFNYEGYWYSEDILQSIPNIHTGFQPQETDIILASFYKSGTTWLKALTFALVQRSKHSLEDHQHPLLHHNPHEIVPNLELDLYLKSSKPDLTKFLSSSSSSPRLFSTHMSLDPLQVPLKENLCKIVYVCRNVKDVMVSVWYFRQSKKITRAEDYSLEAIFESFCNGVTLHGPFWDHALSYWRGSLEDPKHFLFMRYEDLKAEPRTQVKRLAEFLDCPFTKEEEDSGSVDKILELCSLSNLRSVEINKTRTSSRVDFKSYFRKGQVGDWKSYMTPEMVDKIDMIIEEKLKGSGLKF

SEQ ID NO: 676 - protein, 346 aa, Oryza sativa subsp. japonica
  misc_feature: Public GI ID no.115459524
  misc_feature: Bit score of 550.5 for HMM based on sequences of FIGURE 4.
  misc_feature (74)..(339): Pfam Name: Sulfotransfer_1 Pfam Description: Sulfotransferase domain
  misc_feature: Functional Homolog Of Ceres SEEDLINE ID no. ME02549 at SEQ ID NO. 590
MSSSSVQTSPSPSHEVDAETDEELYKQFTDSVSSWPSSEPMPFLPLYRHDKGWYSSLMPMVGAMVADARFAARPSDIIVATLPKSGTTWIKALLYATVHRREHPADAAADHPFNSLGPHECVNFLEYQLYTNNRVPDLGRLPDPRLFATHVPFTSLPSAAAASGCKVVYVCRDPKDNLISMWDFANKFRAREGQEPMSPEAIAELFCLGVSPSGPYWDHVLGYWGAHVARPEQVLFFRYEEMKLDAAAHVRRLAEFVGLPFSAEEEEGGVVDAIVRLCSFDHMIGLEATKSGKTELVVGTAANSSFFRRGQVGDWANHLSPEIAQRIDAITEARFNGSGLRPSGTK

SEQ ID NO: 677 - DNA, 1214 bp, Gossypium hirsutum
  misc_feature: Ceres CLONE ID no.1793353
  misc_feature: Encodes the peptide sequence at SEQ ID NO 678
accaagccctccttgtaacatcgtatttgcactcattagtctgtccctcatggaatcccatcttgagaaacaaaatagagatgtgcttccaaaatctttcgaagagatgatatctactctccctaaagagaattgttggggttttcctgaagatcaatatcaatatcaaggtttttggttccccccgccttttctacaaggagcattgtcggctcaacaacaattccaggctcaacccactgatatcatcctttgtagctctccaagaacaggcacgacctggttaaaatccctcactttcgccactattacaagaacttcatacaatgattccaccacccctttactttccaagatgcctcatgatgttgtgcctttcatggagttcgatcatgcccagttttccactaatcgacatcttggaattcctcttttagccactcatcttccttattccttcttacccagatctacaattgattctggttgcaaacttatttacatttgcagggaccccaaagatacatttgtttcattttatcatttcattgcagggcactgcaaatcccaaaatactcaacccattcaacttgatgaagcgttcgaattgttttatgaaggtgtaagtctgtttgggccttattgggaccatgttttggggtactggaaagcaagtttggaacgtccagacaagttaatgttcttgaaatacgaagatttggttgaagatactgttttgtatcttaagaaaacagcagagtttatgggttatcctttctcgtcagaggaacaacaacaaggggtgcttgaaaacattgtgaagatgtgcagtttcgacaatttaagtggcttggaagtaaataaaaccgggagacatcgtgaagggaaaggaaatttggcgacggaaaataacattttcttccggaacgggaaggttggagactggaaggattatttgaccactgaaatggctcaacgtttagaccaacgaacactgcaaaagttgagcggttcaggtttaagtctgtaattgaaggttcaataatctatttatcggtttacccttttaatgtcgttttaattagagtttgtaattttaataatatcatatttaaaattttctgaaatattgtttattatatattttaaaaattaaaattttataaattgccattgaagtaaaaactaagcatataataaaaatttgtcttccc

SEQ ID NO: 678 - protein, 326 aa, Gossypium hirsutum
  misc_feature: Ceres CLONE ID no.1793353
  misc_feature: Bit score of 384.3 for HMM based on sequences of FIGURE 4.
  misc_feature (63)..(323): Pfam Name: Sulfotransfer_1 Pfam Description: Sulfotransferase domain
  misc_feature: Functional Homolog Of Ceres SEEDLINE ID no. ME02549 at SEQ ID NO. 590
MESHLEKQNRDVLPKSFEEMISTLPKENCWGFPEDQYQYQGFWFPPPFLQGALSAQQQFQAQPTDIILCSSPRTGTTWLKSLTFATITRTSYNDSTTPLLSKMPHDVVPFMEFDHAQFSTNRHLGIPLLATHLPYSFLPRSTIDSGCKLIYICRDPKDTFVSFYHFIAGHCKSQNTQPIQLDEAFELFYEGVSLFGPYWDHVLGYWKASLERPDKLMFLKYEDLVEDTVLYLKKTAEFMGYPFSSEEQQQGVLENIVKMCSFDNLSGLEVNKTGRHREGKGNLATENNIFFRNGKVGDWKDYLTTEMAQRLDQRTLQKLSGSGLSL

SEQ ID NO: 679 - DNA, 972 bp, Populus balsamifera subsp. trichocarpa
  misc_feature: Ceres ANNOT ID no.1467399
  misc_feature: Encodes the peptide sequence at SEQ ID NO 680
atgtctgatgcttcaaaaatcagtgaatctccaaacaccaagaacaaatatgaaaagataatctcaaatcttcgtcaagatgatggctggaaaccagttggaaaactttacgagtatcaaggcttttggtacggtccgtcgttggtacggaatgtaatttcagctcaggagtccttcactccccagccaactgatattgtcttgtgcagctctccaaaaagtggcacagcttggctcaaggcactggccttctccatcgtgtcacgaaatcaggtcaatgattccacaaaccctttgctcaaaaaactgcctcatgagattgtgccctttttggagattgaactggcccaagactcaaacaacagaaaccttgaaaccccatttgtggcaacacatattccttacagttccctgccaagatccataatagactcaagctgtaagatcatctacatatgcagggatcccaaggatgtcctaatttctcactggaattttgatcagcaagtgagtggcatcggctctgaatccttccctctggaagaggcattagagcaatattgtaaagggatctatcctttcggaccgtactgggaccatgttctagggttctggaaagcaagcttggaattcccggagaaagtactcttcgtcaagtatgaagatttgaagactgatgggccgttccatgtaaagagaatggccaagttcatgggccaccccttttccatcgaggaagagcaacaaggagctccagaaaaaattgtgagcatgtgtagtttcgagaatctgagccgtttggaggtgaacaagaatggaaaatactaccttcctgacctccctactttcgagaacaaatcctttttcaggaaaggtaaagcaggtgactggaaaaactatctgacagatggcaaggcagtaaaattcaaccaaattatggaagagaagttcagtggctccggcttggtctga

SEQ ID NO: 680 - protein, 323 aa, Populus balsamifera subsp. trichocarpa
  misc_feature: Ceres ANNOT ID no.1467399
  misc_feature: Bit score of 376.5 for HMM based on sequences of FIGURE 4.
  misc_feature (63)..(321): Pfam Name: Sulfotransfer_1 Pfam Description: Sulfotransferase domain
  misc_feature: Functional Homolog Of Ceres SEEDLINE ID no. ME02549 at SEQ ID NO. 590
MSDASKISESPNTKNKYEKIISNLRQDDGWKPVGKLYEYQGFWYGPSLVRNVISAQESFTPQPTDIVLCSSPKSGTAWLKALAFSIVSRNQVNDSTNPLLKKLPHEIVPFLEIELAQDSNNRNLETPFVATHIPYSSLPRSIIDSSCKIIYICRDPKDVLISHWNFDQQVSGIGSESFPLEEALEQYCKGIYPFGPYWDHVLGFWKASLEFPEKVLFVKYEDLKTDGPFHVKRMAKFMGHPFSIEEEQQGAPEKIVSMCSFENLSRLEVNKNGKYYLPDLPTFENKSFFRKGKAGDWKNYLTDGKAVKFNQIMEEKFSGSGLV

SEQ ID NO: 681 - DNA, 1342 bp, Zea mays
  misc_feature: Ceres CLONE ID no.264002
  misc_feature: Encodes the peptide sequence at SEQ ID NO 682
atatcttagttgcacggttaggtaagacatatggacacaggcagttgcgtctctgtctcttatatacatatgctagatttgctatattgagttgacatgccgttagttgcgatttgcgaagctagctcccaccatctgcgacgccatgtcttcttcctctgtccaacaaacggcctttcccgagcaagaagccgatgcggaaggcgaaacgaaccctgagctctaccagcatttcgccaacttggtctcctccctgccgagctccaaaggcttgtccaacaacaaattctaccgccacgaccaaggctggcactgcagcgtggtgggcatagtgggcgccatggtcgccgacgcgtgcttcagcgcgcgcccctcggacgtcatcgtcgccaccctgcccaagtccggcaccacgtggatgaagtcgctcctgtacgccaccgtgcaccggagagagcgtcccgtcgtcggcgccgccgccgaccagcatcctctcaacagctggggcccccacgaactcatcaagttcttcgagtaccagctctacacgcgggacagggtcccggacctggacaggctccccgaccctcggctcttcgcgacgcacgtccctttcgtgtcgctgccgagctccgtggtcgccacgccgggctgcaagatcgtctacgtgtgccgcgaccccaaggaccacctcgtctccctgtgggacttcgtcaacaaatacttcagggtcaaggatgggctcgagcctctctccgtggaggccgccgccgagctgttctgcgccggcctgaccccgttcgggccgtactgggaccacgtgctcggctactggcgcgcgcaccgcgcggaccccgacaaggtgctcttcttcaggtacgaggagatgcagagggaccccgcggcgcacgtccgcaggctggcggagttcgtcggcctcccattcagctccgaggaggaggacggcggcgtggtggatgccgtcgtggggctgtgctcgttcgagcgcatgaggggcatggcgccgaccaagggtggcaggactgagttcccgatcggcgtggtgcccaacagctccttcttccggcagggcgtggtgggggactgggtgaaccacctgtcaccggagatggcgcgccgcattgacgcgatcactgcagacaagttcaggggttcgagtctcgtcgtctagctagctgttacggatcaatcatcactcatcatcagtgcgccactctaccgtggtttctcaaatgctcaataatgcaaggactacctattagtattctatatctatactattctattaataagaacttatatatgttgctatcgcggctcc

SEQ ID NO: 682 - protein, 348 aa, Zea mays
  misc_feature: Ceres CLONE ID no.264002
  misc_feature: Bit score of 849.0 for HMM based on sequences of FIGURE 4.
  misc_feature (76)..(345): Pfam Name: Sulfotransfer_1 Pfam Description: Sulfotransferase domain
  misc_feature: Functional Homolog Of Ceres SEEDLINE ID no. ME02549 at SEQ ID NO. 590
MSSSSVQQTAFPEQEADAEGETNPELYQHFANLVSSLPSSKGLSNNKFYRHDQGWHCSVVGIVGAMVADACFSARPSDVIVATLPKSGTTWMKSLLYATVHRRERPVVGAAADQHPLNSWGPHELIKFFEYQLYTRDRVPDLDRLPDPRLFATHVPFVSLPSSVVATPGCKIVYVCRDPKDHLVSLWDFVNKYFRVKDGLEPLSVEAAAELFCAGLTPFGPYWDHVLGYWRAHRADPDKVLFFRYEEMQRDPAAHVRRLAEFVGLPFSSEEEDGGVVDAVVGLCSFERMRGMAPTKGGRTEFPIGVVPNSSFFRQGVVGDWVNHLSPEMARRIDAITADKFRGSSLVV

SEQ ID NO: 683 - DNA, 1263 bp, Gossypium hirsutum
  misc_feature: Ceres CLONE ID no.1982930
  misc_feature: Encodes the peptide sequence at SEQ ID NO 684
acaaagcaacccttgaaatatagtatttgcactcattagcctgtccctcatggaatcccatcttgagaaacaaaatggagatgtgcttcaacaatctttcaaagagatgatatctactctccctaaagagaatcgttggggttttcttgaagattattatcaatatcaaggtttttggatctccccgtcttttctacaaggagcgttgtcagctcaacaacaattccaagctcaacccactgatgtcatcctttgtagctctctaagaacaggcacaggctggttaaaatccctcactttcgccactattacaagaacttcatacaatgattccaccacccctttacttcacacgctgcctcatgatgttgtgcctttcttggagttcgatcattcccagttttctgctaatctacatcttggaattcctcttttagccactcatcttccttattccttcttacccagatctataattgattctggttgtaaaattatttacatttgcagggaccccaaagatacatttgtttcattgtatcatttcattgcagggcactgcaaatccaaaaatgctcaacccattcaacttgatgaagcgttcgaattgttttatgaaggtgtaagtccgttcggcccttattgggaccatgttttggggtactggaaagcaagtttggaacatccagacaagttaatgttcttgaaatatgaagaactggttgaagatactgttttgtatcttaagaaaattgcagagtttatgggttatcctttctcgtcagaggaacaacaacaaggggtgcctgaaaacattgtacagctgtgcagtttcgacaatttaagtggcttggaagtaaataaaaccgggaaacactgtgaagggcaaggaaatttggagatggaaaataacattttctttcggaaagggaaggttggagactggaagaattatttgaccactgaaatggctcaacgttttgaccaacgaacaatgcaaaagttgagcggttcaggtttaagtctctaattgaagatctataatctatttattgcttaaacctgatcagagttcgtaattatctcttttaataatattactttcaaataagatcatcttggccgagatttataattagtaccagtagtctcatataaatctattgtactattttttgaattttggagctcgttgatggaacttcaataattaaataacttaaataaaagctaagcatagtataaaaaaaaaaaaaaaaaaaa

SEQ ID NO: 684 - protein, 326 aa, Gossypium hirsutum
  misc_feature: Ceres CLONE ID no.1982930
  misc_feature: Bit score of 397.2 for HMM based on sequences of FIGURE 4.
  misc_feature (63)..(323): Pfam Name: Sulfotransfer_1 Pfam Description: Sulfotransferase domain
  misc_feature: Functional Homolog Of Ceres SEEDLINE ID no. ME02549 at SEQ ID NO. 590
MESHLEKQNGDVLQQSFKEMISTLPKENRWGFLEDYYQYQGFWISPSFLQGALSAQQQFQAQPTDVILCSSLRTGTGWLKSLTFATITRTSYNDSTTPLLHTLPHDVVPFLEFDHSQFSANLHLGIPLLATHLPYSFLPRSIIDSGCKIIYICRDPKDTFVSLYHFIAGHCKSKNAQPIQLDEAFELFYEGVSPFGPYWDHVLGYWKASLEHPDKLMFLKYEELVEDTVLYLKKIAEFMGYPFSSEEQQQGVPENIVQLCSFDNLSGLEVNKTGKHCEGQGNLEMENNIFFRKGKVGDWKNYLTTEMAQRFDQRTMQKLSGSGLSL

SEQ ID NO: 685 - protein, 358 aa, Oryza sativa subsp. indica
  misc_feature: Public GI ID no.125540700
  misc_feature: Bit score of 406.1 for HMM based on sequences of FIGURE 4.
  misc_feature (81)..(349): Pfam Name: Sulfotransfer_1 Pfam Description: Sulfotransferase domain
  misc_feature: Functional Homolog Of Ceres SEEDLINE ID no. ME02549 at SEQ ID NO. 590
MATAGVTEHLLSPRAGAGDDMSAGDGEGWCNALAKYEALASSLPSCHGLGSAPYRRYGGFWYPAHLMPATLAARDTFVARPSDVILATMPKSGSTWLKALAFCVVHRGRHTPAAGQHPLLHSSPHDLVPFLHSIYEISRSCRVAPGHRLDAMPSPRILAVHEPLSSLPASVKASGCRVVYLCRDPKDAFVSLRHYLDEIKPEGSTMTPFDEAFELLCDGVSPYGPMWDHAAEYWKESLARPEEVVFLRYESLKEDGVGSVRRLAGFLGCPFTGEELAGGVPETIVELCSMERMRNVEANRDGEHGATWSSFKNSAFFRKGEVGDWKKHMSPEMARRLDDVVEEKLRGSGMSLIRHRQY

SEQ ID NO: 686 - DNA, 1044 bp, Populus balsamifera subsp. trichocarpa
  misc_feature: Ceres ANNOT ID no.1448743
  misc_feature: Encodes the peptide sequence at SEQ ID NO 687
atgtcttactctcctaatcttcaaaaagcttcaaacagtactaaccactacgaagaagatcaacaacaacaacaacagatcaaaagccagtcccagaaatatgaagagattatttcaacccttcctaaggatcaatatggatggttggatgagcattacaagattgaaggattttggtatgatcctgtttgggctgttggagttctttgggcacaggaaaacttccaggcacgctctagtgatattattttggcttcatttcccaagtgtggcaccacatggctgaaggctctcatgtttgccatccagaagagaaatgatcgttgcctcaatgattcaactcaccctttactcactacaaacccccataagtgtgttccctattttgagctgcaagctcatgaagatgacccatttacatacctagattctcttccctcacctaggctacttggcacacatatctcttacacttcactgccgaaatccatcataaattcaggttctaagattgtgtgtatctgtcgggactcgaaagatgttttggcctccttgtggaagtttgtcaataaaataagatctggaaggaacatgctacccctgcctctggaagaagggtttgagcttttctgtaaaggagtttgtctttcaggacccttttgggagtacaattcggagtactggaacgcaagtttagaacgtccgaataatgtattttttctcaagtatgaggatctgaagaaggatactgctttttacgtgcagaagctggcacgattcatggaatgtcccttctcggtggatgaaaaaagtaaaggtgtcgtgaaagacataataaagctatgtagtcttgagaatttgagcaatctggaggtgaataaagctggaacatttcatctgggctccaaagcgaaggtggacaacaatgcattcttccggcgaggtaacgttggagattcgaagacttgtctgacgcctacgatgatcaagcgacttgatgagattacaaaggcaaagttcaaagggtctggactggcaatttag

SEQ ID NO: 687 - protein, 347 aa, Populus balsamifera subsp. trichocarpa
  misc_feature: Ceres ANNOT ID no.1448743
  misc_feature: Bit score of 408.7 for HMM based on sequences of FIGURE 4.
  misc_feature (79)..(344): Pfam Name: Sulfotransfer_1 Pfam Description: Sulfotransferase domain
  misc_feature: Functional Homolog Of Ceres SEEDLINE ID no. ME02549 at SEQ ID NO. 590
MSYSPNLQKASNSTNHYEEDQQQQQQIKSQSQKYEEIISTLPKDQYGWLDEHYKIEGFWYDPVWAVGVLWAQENFQARSSDIILASFPKCGTTWLKALMFAIQKRNDRCLNDSTHPLLTTNPHKCVPYFELQAHEDDPFTYLDSLPSPRLLGTHISYTSLPKSIINSGSKIVCICRDSKDVLASLWKFVNKIRSGRNMLPLPLEEGFELFCKGVCLSGPFWEYNSEYWNASLERPNNVFFLKYEDLKKDTAFYVQKLARFMECPFSVDEKSKGVVKDIIKLCSLENLSNLEVNKAGTFHLGSKAKVDNNAFFRRGNVGDSKTCLTPTMIKRLDEITKAKFKGSGLAI

SEQ ID NO: 688 - protein, 358 aa, Oryza sativa subsp. japonica
  misc_feature: Public GI ID no.50251910
  misc_feature: Bit score of 399.4 for HMM based on sequences of FIGURE 4.
  misc_feature (81)..(349): Pfam Name: Sulfotransfer_1 Pfam Description: Sulfotransferase domain
  misc_feature: Functional Homolog Of Ceres SEEDLINE ID no. ME02549 at SEQ ID NO. 590
MATAGVTEHLLSPRAGAGDDMSAGDGEGWCNALAKYEALASSLPSCHGLGSAPYRRYGGFWYPAHLMPATLAARDTFVARPSDVILATMPKSGSTWLKALAFCVVHRGRHAPAAGQHPLLHSSPHDLVPFLHSIYEISRSCRVAPGHRLDAMPSPRILAVHEPLSSLPASVKASGCRVVYLCRDPKDAFVSLRHYLDEIKPEGSTMTPFDEAFELLCDGVSPYGPMWDHAAEYWKESLARPEEVVFLRYESLKEDGVGSVRRLAGFLGCPFTGEELAGGVPETIVELCSMERMRNVEANRDGEHGATWSSFKNSAFFRKGEVGDWKEHMSPEMARRLDDVVEEKLRGSRMSLIRHRQY

SEQ ID NO: 689 - DNA, 1257 bp, Gossypium hirsutum
  misc_feature: Ceres CLONE ID no.1836748
  misc_feature: Encodes the peptide sequence at SEQ ID NO 690
cgacacagccatccttgtataatatagtatttgcactcattagcctgtctctcatggaatcccatattgagaaacaaaatagagatgtgcttcaaaaatctttcaaagagatgatatctactctccctaaagagaattgttggggtattcctgaagctctatatcaatatcagggtttttggctcacccccccttttctacaaggagcattgtcggctcaacaacaattccaggctcaacccactgatatcatcctttgtagctctccaagaacaggtgcagcctggttaaaatccctcactttcgccactattacaagaacttcatacaatgattccaccacccctttactttccaagatgcctcatgatgttgtgcctttcatggagttcgatcatgcccagttttccactaatcgacatcttggaattcctcttttagccactcatcttccttattccttcttacccagatctataattgattctggttgtaaacttatttacatttgcagggaccccaaagatacatttgtttcattgcatcatttcaatgcaaggtacaacaaatcccaaaatactcaacccgttcaacttgatgaagcgttcgaattgttttatgaaggtgtaaattggtatgggccttattgggaccatgttctggggtactggaaagcaagtttggaacatccagacaagttactattcttgaaatatgaagaactgattgaagatactgttttgtatcttaagaaaatagcagaatttatgggttatcctttctcgtcagaggaacaacaacaagcggtgcctgaaaacattgtacagctgtgcagtttcgagaatttaaatggcttggaagtaaataaaactgggaaacatcgtggcgggcaaggagatttggcgatggaaaataacattttcttccggaaagggaaggttggagactggaagaattatttgacaactgaaatggctcgacgtttagaccaacgaacactgcaaaagtttcgcggttcaggtttaagtgtctaactgaaggtccacaatctatttatcagagatcagaattggtaattatgccttttaataatattatcttcaaataaggtcatcttgatcaagatttgtaattatcccatttagtaatattgatggggattgatttattgtactattcctccgatctttagttggagctcgttagtagaatcttatcagttaaatgattatttctcaaaaaaaaaaaaaaaaaaaa

SEQ ID NO: 690 - protein, 326 aa, Gossypium hirsutum
  misc_feature: Ceres CLONE ID no.1836748
  misc_feature: Bit score of 389.3 for HMM based on sequences of FIGURE 4.
  misc_feature (63)..(323): Pfam Name: Sulfotransfer_1 Pfam Description: Sulfotransferase domain
  misc_feature: Functional Homolog Of Ceres SEEDLINE ID no. ME02549 at SEQ ID NO. 590
MESHIEKQNRDVLQKSFKEMISTLPKENCWGIPEALYQYQGFWLTPPFLQGALSAQQQFQAQPTDIILCSSPRTGAAWLKSLTFATITRTSYNDSTTPLLSKMPHDVVPFMEFDHAQFSTNRHLGIPLLATHLPYSFLPRSIIDSGCKLIYICRDPKDTFVSLHHFNARYNKSQNTQPVQLDEAFELFYEGVNWYGPYWDHVLGYWKASLEHPDKLLFLKYEELIEDTVLYLKKIAEFMGYPFSSEEQQQAVPENIVQLCSFENLNGLEVNKTGKHRGGQGDLAMENNIFFRKGKVGDWKNYLTTEMARRLDQRTLQKFRGSGLSV

SEQ ID NO: 691 - protein, 324 aa, Brassica napus
  misc_feature: Public GI ID no.3420006
  misc_feature: Bit score of 322.1 for HMM based on sequences of FIGURE 4.
  misc_feature (65)..(319): Pfam Name: Sulfotransfer_1 Pfam Description: Sulfotransferase domain
  misc_feature: Functional Homolog Of Ceres SEEDLINE ID no. ME02549 at SEQ ID NO. 590
MSSSSSVPDYLRDENLTQKTKDLISSLPSEKGWLVCQMYQFQGRWHTQALLQGILTCQKHFEAKDSDIILVTNPKSGTTWLKALVFALINRHKFPVYSVIILSCYQSALLVPFLGRSLLRSPDFDFSQLSSPRLMNTHISHLSLPESVKSSSCKIVYCCRNPKDMFVSLWHFGKKLAPEETADYPIEKAVEAFCQGKFIGGPFWDHVLEYWYASLENPNKVLFVSYEEPKKKTGETIKRIAEFLGCGLVGEEEVRAIVKLCSFESLSSLEVNREGKLPSGMETRAFFRKGEVGGWRDTLTESLAEVIDRTIEEKFQGSGLKFSC

SEQ ID NO: 692 - protein, 270 aa, Medicago truncatula
  misc_feature: Public GI ID no.92879376
  misc_feature: Bit score of 370.5 for HMM based on sequences of FIGURE 4.
  misc_feature (14)..(261): Pfam Name: Sulfotransfer_1 Pfam Description: Sulfotransferase domain
  misc_feature: Functional Homolog Of Ceres SEEDLINE ID no. ME02549 at SEQ ID NO. 590
MASREEDHKAPLGLKALTYAIVNRHSLEMHDHPLLKSNSHELVPYFEFNIYGDNLDQTPLIDLSNMAEPRLFGTHIPFNSLAKSIKESNCKIIYICRNPLDTFISTWFFINKIRSNESLPMLNLEEAFEMYCKGRNLSGPFWNHMLGYYKESIARPGKVLFLNYEELKQDANYQVKRIAEFLGCPFTQEEESNRMIQNIINLCCFENMKDQEVNKFGVLSSRYEKKHLFRKAEIGDWKNYLSRSMVEKISKITKEMLGGLSFEVCRSIDQ

SEQ ID NO: 693 - DNA, 1180 bp, Triticum aestivum
  misc_feature: Ceres CLONE ID no.838941
  misc_feature: Encodes the peptide sequence at SEQ ID NO 694
gccgtgacattcctccactctcgatcgccggctcgtccagttgccgcctccaaagagaagccatgaatgctgctctcaccgtcgccgtagccggggaagaaatcgacgaggccgtagccggggaagaaatcgacgaggccgcctctcgggctcaggctgacatgtcggagatcatgtcgtcgctcccacggtgcccggtgtaccttactcgccactaccgcggcttctggatccgcgagttcgtcctcaagggcatggccgccgctcaggcatccttcgagccaaggccaaccgacgtcttcctcgccagctgccccaagtccggcaccacctggctcaaggcgctcgcctttgcgacgctcaaccgcgccacgcacttgccgtccgactccaaccacccgctatgccaccgcaacccgcacgactgcgtcgccttcctccagaccaggcccgtgcctgagaccatggcgctcccttctccccggctgctcgcaacccacatcccctgctccctcctgcccagccgcataacggaatgcggccgggtcgtctacgtgtgccgggagccaaaggacgctctggtctccttctggatctacaacaacaagatcgcgccgatgctgcgccggaagttcggcctggagtctccctcgcccacgttcgaggaggcgttcgagctcttctgcgaggggcagagcagctccggaccgccatggcgccacgccctcgagtactgggaggagagccggaggaggcctgggaaggtgctcttcctcaggtacgaggacatgctgcaagaccccacaggcaacgccaacaatctcgctgcgttcatggggtgcccgttttcttgcgcagaggaggaggcaggggtggtgcaggagatcgtgcagctctgtagctttgagaaactcaagagctcggaggtgaacaagaatggcagcagcgccatgatgggcgtcaacaacgacgtatacttcaggaagggagcggtcggcgactggaaaaactacatgacgccggagatggcggcgcggctggacaagatcgtcgaggaggcgcttcaaggttcaggcctgacctttggcatctccatgtagaagggatggggagcgaattgttgctatgaagcataaattttcgtatttgacaatcccaaagaaaataaggtcttatgatc

SEQ ID NO: 694 - protein, 345 aa, Triticum aestivum
  misc_feature: Ceres CLONE ID no.838941
  misc_feature: Bit score of 390.1 for HMM based on sequences of FIGURE 4.
  misc_feature (76)..(338): Pfam Name: Sulfotransfer_1 Pfam Description: Sulfotransferase domain
  misc_feature: Functional Homolog Of Ceres SEEDLINE ID no. ME02549 at SEQ ID NO. 590
MNAALTVAVAGEEIDEAVAGEEIDEAASRAQADMSEIMSSLPRCPVYLTRHYRGFWIREFVLKGMAAAQASFEPRPTDVFLASCPKSGTTWLKALAFATLNRATHLPSDSNHPLCHRNPHDCVAFLQTRPVPETMALPSPRLLATHIPCSLLPSRITECGRVVYVCREPKDALVSFWIYNNKIAPMLRRKFGLESPSPTFEEAFELFCEGQSSSGPPWRHALEYWEESRRRPGKVLFLRYEDMLQDPTGNANNLAAFMGCPFSCAEEEAGVVQEIVQLCSFEKLKSSEVNKNGSSAMMGVNNDVYFRKGAVGDWKNYMTPEMAARLDKIVEEALQGSGLTFGISM

SEQ ID NO: 695 - DNA, 1017 bp, Populus balsamifera subsp. trichocarpa
  misc_feature: Ceres ANNOT ID no.1437746
  misc_feature: Encodes the peptide sequence at SEQ ID NO 696
atggagacagccaatgaagatagtttccaagaatttgtactcaaccttcctcgtgggaaagactgggatggcgctcccctccttctttacaatgatacgtggtatccagcctactgcattagaggtgtggtttcctttcaacaaaacttcagggcacaagccaccgacataatagtagcaagcttgccaaagtcagctactacttggttgaaggcactcaccttctcggttgtaaaccgagatcgctacagtcccaaagagagtcccctgaccaccaccccacctcgtgaactgatgcccttctttgagaatgatctttacttgaaaagcccgaacccagatcttgattttcctcctccaagaatccttgcttgtcacacacattacacgtctctgccacagtccatcagagattccaactgtaaaattgtgtacatatgtaggaatcctttggaccaggctgtctcttattttcatttccttcgaaacatagtgtcaggcagcacaaaaccgttatcatcaattgatgaatgtttcgagaacatatgtcgcggtgttcagagtcacggacccttttggaatagtatgttgagctattggaaagcaagcttggaaagaccagacaaggtgttgtttttgaagtatgaggagctgaaagaggatattatcttgaacttgaagagttttgacaatctcaaggatttggaagtgaaccgaaatggtgtccattcttcaggattttcaaatagtgccttcttcaggaaaggagaggtgggagattggggcaatcatctcactccttccatggctgaacgtttctggaagatcgtggaagaaaagttggatggatctggtttaaccttcaaattatctcaatggattaacggatttgacagacaggcgctttctttcaagaaaggtcactggatagcaactcatcctgaaccgtacgtagtagctgcttccggtggggatatcttccaagaaatccaccccggccctgattttctcctctga

SEQ ID NO: 696 - protein, 338 aa, Populus balsamifera subsp. trichocarpa
  misc_feature: Ceres ANNOT ID no.1437746
  misc_feature: Bit score of 340.7 for HMM based on sequences of FIGURE 4.
  misc_feature (54)..(285): Pfam Name: Sulfotransfer_1 Pfam Description: Sulfotransferase domain
  misc_feature: Functional Homolog Of Ceres SEEDLINE ID no. ME02549 at SEQ ID NO. 590
METANEDSFQEFVLNLPRGKDWDGAPLLLYNDTWYPAYCIRGVVSFQQNFRAQATDIIVASLPKSATTWLKALTFSVVNRDRYSPKESPLTTTPPRELMPFFENDLYLKSPNPDLDFPPPRILACHTHYTSLPQSIRDSNCKIVYICRNPLDQAVSYFHFLRNIVSGSTKPLSSIDECFENICRGVQSHGPFWNSMLSYWKASLERPDKVLFLKYEELKEDIILNLKSFDNLKDLEVNRNGVHSSGFSNSAFFRKGEVGDWGNHLTPSMAERFWKIVEEKLDGSGLTFKLSQWINGFDRQALSFKKGHWIATHPEPYVVAASGGDIFQEIHPGPDFLL

SEQ ID NO: 697 - DNA, 990 bp, Sorghum bicolor
  misc_feature: Ceres ANNOT ID no.6017241
  misc_feature: Encodes the peptide sequence at SEQ ID NO 698
atggaacaagccaaggagggaagcgccacagatagctcgtccgaagccatttcatctcaaagccacagtacccatcttctctccaaacttccaacaagagagggttggacacagccactggtgctctacaagaacttctggatccgtccgccaatggctattaacatcatgcacctccagaacagttttaaagctcgccaagacgatatcatcattgcatccaaccctaagtgtggcaccacatggttgaaggcgctcgccttcacaataaccaatcgctccaggtatgagtttggaaatcaccctcttctctttcgtcatccccaggaggtgattccatttatcgagatccctcttggcgtggagctgacttatgtggacacgctctcttccccaagagttctcgccacccatatgcccttttcattgctcccaaactccataactacttgtggttgtcggattgtgtacatctgccgagggccaaaggatgcctttgtgtctcgatggcattttgagaataagattagtagagaatatagcatcaatgtggaagatgctcttgacatgttctgtgaaggtttctcaccctatggtcctttttgggagcactgcctcgagtactggagggagagcatcgcaagtcctgacaaggttctttttctcaagtatgaggatatgacatcagaaccagtgaagtatgtcaaaaggatcgcatcgttccttggcgtcccattcagtattaaggaacaagaagatggggtgcctgaggaggttgtgagattatgcagcttcgagaagctcagcggcttgcatgccaatcaggcagcaggagacatcgctcggcatggcaacatggtcattgacaagtcggtgttctttagaaaaggaatcgtgggggattgggtgaatcacattagtgaagagatggggagaaagatagattccgttatagaagagaaactcaagggatctggccttgtgttttaa

SEQ ID NO: 698 - protein, 329 aa, Sorghum bicolor
  misc_feature: Ceres ANNOT ID no.6017241
  misc_feature: Bit score of 430.0 for HMM based on sequences of FIGURE 4.
  misc_feature (67)..(326): Pfam Name: Sulfotransfer_1 Pfam Description: Sulfotransferase domain
  misc_feature: Functional Homolog Of Ceres SEEDLINE ID no. ME02549 at SEQ ID NO. 590
MEQAKEGSATDSSSEAISSQSHSTHLLSKLPTREGWTQPLVLYKNFWIRPPMAINIMHLQNSFKARQDDIIIASNPKCGTTWLKALAFTITNRSRYEFGNHPLLFRHPQEVIPFIEIPLGVELTYVDTLSSPRVLATHMPFSLLPNSITTCGCRIVYICRGPKDAFVSRWHFENKISREYSINVEDALDMFCEGFSPYGPFWEHCLEYWRESIASPDKVLFLKYEDMTSEPVKYVKRIASFLGVPFSIKEQEDGVPEEVVRLCSFEKLSGLHANQAAGDIARHGNMVIDKSVFFRKGIVGDWVNHISEEMGRKIDSVIEEKLKGSGLVF

SEQ ID NO: 699 - DNA, 993 bp, Sorghum bicolor
  misc_feature: Ceres ANNOT ID no.6085947
  misc_feature: Encodes the peptide sequence at SEQ ID NO 700
atggatgcgcaacgccttctccagtatgaggaattggcgtcgtccctccctgcatcccagaagggtatcgggagctccccgtaccggaagcacgaaggcttctggtacccggagcaccagctggcgccgacgctggcgatgcgggacacgttcgtcgcccgcccgaccgacatcatcctcgccaccattcccaagtccggcacgacgtggcttaaggccctcgtctactgtgtcgtccaccgcggccaccacgcgccggccgacgagcgccacccactcctcgtctccagcccgcacgacgtggtcccgttcctgcactccatctacgagaaccaccgctccgcgtcgcccgtcccggtcctcgaagagatgccgtcgccgcgtgtcctggccgtgcacgcgccgttcacggccctgccgccatcggtgcgggagtccgcgtgccgcgtcgtctatctgtgccgagaccccaaggacacttttgtctcgctccgtcactacgtcgacaagatcaagcccgagggatccgccatgacgccgttcgccgaggcgttcgacctgttctgcgacggcgtgtcaccgtttgggccggtctgggacaacatggccgagtactggaagaagagcatggcgcggccggaggaggtggtgttcctccggtacgaggacctgaaggaggacactgtggggaacgtgaggcgcctagcggcgttcctcggctgcccattcaccgacgaggaggcagagagaggcgtccctgaggcgattgtgacgctgtgcagtatggacaagatgaggagcgtcaaggccaaccgggatgggatgcactggaacggccgttcacgattcaagaactcggccttctttcgaaagggggaggtcggtgactggaaggcgcacatgacgctggatatggcgaggagactggatgacatcgtggaggaaaaactgcgaggaataggatctgggctctccatgatcggccagccatga

SEQ ID NO: 700 - protein, 330 aa, Sorghum bicolor
  misc_feature: Ceres ANNOT ID no.6085947
  misc_feature: Bit score of 394.2 for HMM based on sequences of FIGURE 4.
  misc_feature (55)..(321): Pfam Name: Sulfotransfer_1 Pfam Description: Sulfotransferase domain
  misc_feature: Functional Homolog Of Ceres SEEDLINE ID no. ME02549 at SEQ ID NO. 590
MDAQRLLQYEELASSLPASQKGIGSSPYRKHEGFWYPEHQLAPTLAMRDTFVARPTDIILATIPKSGTTWLKALVYCVVHRGHHAPADERHPLLVSSPHDVVPFLHSIYENHRSASPVPVLEEMPSPRVLAVHAPFTALPPSVRESACRVVYLCRDPKDTFVSLRHYVDKIKPEGSAMTPFAEAFDLFCDGVSPFGPVWDNMAEYWKKSMARPEEVVFLRYEDLKEDTVGNVRRLAAFLGCPFTDEEAERGVPEAIVTLCSMDKMRSVKANRDGMHWNGRSRFKNSAFFRKGEVGDWKAHMTLDMARRLDDIVEEKLRGIGSGLSMIGQP

SEQ ID NO: 701 - DNA, 1005 bp, Sorghum bicolor
  misc_feature: Ceres ANNOT ID no.6017242
  misc_feature: Encodes the peptide sequence at SEQ ID NO 702
atggcgcaagttcactctgaaatcaaagagagctccactaatgaaagtagcaacagtgaagctgatcttgtagctagacttcccacaagggaaggatgggcgacacctctcaccctctacaaccagtgctggctgagatcacacacggtaggaaaattcatggccgtgagagacaacttcaagccccgcggcgacgacatcatcctggcgacgcaccccaagagcggaaccaactggctcaaggccctcgccttcaccatcttcaaccgctcccgctgcagcctcgacaacaaccatcagcagcaccctctgctcacgaccaccccacagatggccgtgcccttcatcggcttcagctccacgggtggtggcgacctcgaccacctggagacgctgccgtcgccgaggctgctgtcgacccaccttcccctctcgctgctcccgcccgccgtctccaccctcggctgcagggtggtgtacctctgccgggagcccaaggatgccttcgtctcgaggtggcactttgagaacatgatcggcacaggggcccccgtcggcctcgacgctgccttcgccatgttctgcgagggctgctctcctttcggccctttctgggagcactaccttgagtactggaatgagagctcggcgaggccacgagaggtgatgtttctcaggtacgaacagatggcgtctgacacgctccaggttgccaggaagcttgcgaccttcctcggtgtccccttcactcaggaggaggacgaccgtggagttgcccagcaggttgtcagcttctgcagcttcgactcgcttcgcagctttcaagctaataaagcatcgccagatggtgttgaggtggcagggggcaagcttttcttccagcgctcttccgtgtttaggaaaggcaaggtcggggactggaccaaccacatgagcaaagagatgggacaagaattggatcgcctcgtggaggacaacttcaaaggatctggtctggtgttctga

SEQ ID NO: 702 - protein, 334 aa, Sorghum bicolor
  misc_feature: Ceres ANNOT ID no.6017242
  misc_feature: Bit score of 328.9 for HMM based on sequences of FIGURE 4.
  misc_feature (64)..(331): Pfam Name: Sulfotransfer_1 Pfam Description: Sulfotransferase domain
  misc_feature: Functional Homolog Of Ceres SEEDLINE ID no. ME02549 at SEQ ID NO. 590
MAQVHSEIKESSTNESSNSEADLVARLPTREGWATPLTLYNQCWLRSHTVGKFMAVRDNFKPRGDDIILATHPKSGTNWLKALAFTIFNRSRCSLDNNHQQHPLLTTTPQMAVPFIGFSSTGGGDLDHLETLPSPRLLSTHLPLSLLPPAVSTLGCRVVYLCREPKDAFVSRWHFENMIGTGAPVGLDAAFAMFCEGCSPFGPFWEHYLEYWNESSARPREVMFLRYEQMASDTLQVARKLATFLGVPFTQEEDDRGVAQQVVSFCSFDSLRSFQANKASPDGVEVAGGKLFFQRSSVFRKGKVGDWTNHMSKEMGQELDRLVEDNFKGSGLVF

SEQ ID NO: 703 - DNA, 406 bp, Arabidopsis thaliana
  misc_feature: Ceres SEEDLINE ID no.ME02865
  misc_feature: Expected Sequence
  misc_feature: Encodes the peptide sequence at SEQ ID NO. 705
  misc_feature (31)..(31): n is a, c, t, g, unknown, or other
atctatattttctaaggaaaaaacttcatcnaaaaaaaagaaaagaaagaagataaatggcgtctaacaaagtctcattcttcttggttctttgcctttgtgttctctcaacagcagagtttggagaagcacaaattctaacaggaataaaatgcccagatccaaacggctacgacaaagaagataaatgtaatatttactgcaaggatcaaaattatatgggtggttcttgtcaaggttacaaaaatcattatatgtgtgaatgctatgtaggataaaaatacatctcatggttgaatttctgctactcacagttaaacatgtatctcttgtcaatttcttatcatatatagtgggatttatgaaataatgtggaacacaaaaacctataaatgtaagggttatc

SEQ ID NO: 704 - DNA, 406 bp, Arabidopsis thaliana
  misc_feature: Ceres SEEDLINE ID no.ME02865
  misc_feature: Inplanta Sequence
  misc_feature: Encodes the peptide sequence at SEQ ID NO. 705
atctatattttctaaggaaaaaacttcatcaaaaaaaaagaaaagaaagaagataaatggcgtctaacaaagtctcattcttcttggttctttgcctttgtgttctctcaacagcagagtttggagaagcacaaattctaacaggaataaaatgcccagatccaaacggctacgacaaagaagataaatgtaatatttactgcaaggatcaaaattatatgggtggttcttgtcaaggttacaaaaatcattatatgtgtgaatgctatgtaggataaaaatacatctcatggttgaatttctgctactcacagttaaacatgtatctcttgtcaatttcttatcatatatagtgggatttatgaaataatgtggaacacaaaaacctataaatgtaagggttatc

SEQ ID NO: 705 - protein, 73 aa, Arabidopsis thaliana
  misc_feature: Ceres SEEDLINE ID no.ME02865
  misc_feature: Bit score of 216.6 for HMM based on sequences of FIGURE 5.
MASNKVSFFLVLCLCVLSTAEFGEAQILTGIKCPDPNGHDKEDKCNIYCLNQNYMGGSCQGYKNHYMCECYVG

SEQ ID NO: 706 - protein, 73 aa, Arabidopsis thaliana
  misc_feature: Public GI ID no.79320952
  misc_feature: Bit score of 212.8 for HMM based on sequences of FIGURE 5.
  misc_feature: Functional Homolog Of Ceres SEEDLINE ID no. ME02865 at SEQ ID NO. 705
MASNKVSFIFILFLCVLSTAEFGEAQNPRGRKCEDPNGVDQKAKCYIYCNEQGFLGGSCQGYTNHYMCECYVG

SEQ ID NO: 707 - protein, 74 aa, Arabidopsis thaliana
  misc_feature: Public GI ID no.79320957
  misc_feature: Bit score of 206.1 for HMM based on sequences of FIGURE 5.
  misc_feature: Functional Homolog Of Ceres SEEDLINE ID no. ME02865 at SEQ ID NO. 705
MASNKVSFFLVLCLCILLAGECIESPIFTGNKCSDPTGMDKDGKCLDYCHAQGYPGGSCIGFIDQGYMCVCKVG

SEQ ID NO: 708 - protein, 315 aa, Arabidopsis thaliana
  misc_feature: Public GI ID no.6692094
  misc_feature: Bit score of 58.2 for HMM based on sequences of FIGURE 5.
  misc_feature: Functional Homolog Of Ceres SEEDLINE ID no. ME02865 at SEQ ID NO. 705
MNDADASIQIQQMVRFIRQEAEEKANEISISSEEEFNIEKLQLVEAEKKKIRQEYEKKEKQVDVRKKIDYSMQLNASRIKVLQAQDDIVNAMKEEAAKQLLKVSQHGFFNHHHHQYKHLLKDLIVQCLLRLKEPAVLLRCREEDLDIVESMLDDASEEYCKKAKVHAPEIIVDKDIFLPPAPSDDDPHALSCAGGVVLASRDGKIVCENTLDARLEVAFRNKLPEFCSKGSFLEMCVDPKVALRQGWCSLMSDSNFITKEKLRDAKSMNPTGRRCPDPNGVEKKSMCYSSCKTQGFMGGSCQGHKGNYMCECYEG

SEQ ID NO: 709 - protein, 72 aa, Arabidopsis thaliana
  misc_feature: Public GI ID no.145323049
  misc_feature: Bit score of 107.9 for HMM based on sequences of FIGURE 5.
  misc_feature: Functional Homolog Of Ceres SEEDLINE ID no. ME02865 at SEQ ID NO. 705
MASNKISFSFVLCLYMCSLLDAKSMNPTGRRCPDPNGVEKKSMCYSSCKTQGFMGGSCQGHKGNYMCECYEG

SEQ ID NO: 710 - DNA, 716 bp, Arabidopsis thaliana
  misc_feature: Ceres SEEDLINE ID no.ME03227
  misc_feature: Encodes the peptide sequence at SEQ ID NO. 711
aaacaacgtttcgtcttctcagattctttacctttcttaaggaaaaaccccaaaagagagaagataaaaatctcgcattcagattttagggtttctgacaaattctccgacgaaattcaagatccgaatctcggcaatgtcgacaatctcgccgtcattagccgtaattgcgtttctttttctgattcttctgaatctatcttcggttttcgctgatccttcgacggaaggaggagagattattaggttaccttcggagaagatcaacggtgaaaaaaacagaggcgaattctgtgaaggaattgctaaaccggcttcgtgtccggttcagtgtttcaggcctgatccggtttgcggtgaagacagcgttacttactggtgcggttgtgcagatgctttgtgccatggtgttcgtgttgtgaaacaaggagcttgtgatgttggtaatggtgttggtttgtctgttcctggacaagctctgcttttgatacacattgtctggatgatgcttcttgggttttctattctctttgggctcttttgattttggttctaatttctctgaatcaaaacaacatatagaagattgtttaggttttcagattgcaaatgacgaatcttttttgtttatactcttctttttttctttatattgctctgtattcatattacattaaaactatgaggaaatattattattatttggtttgttgcgc

SEQ ID NO: 711 - protein, 135 aa, Arabidopsis thaliana
  misc_feature: Ceres SEEDLINE ID no.ME03227
  misc_feature: Bit score of 342.0 for HMM based on sequences of FIGURE 6.
MSTISPSLAVIAFLFLILLNLSSVFADPSTEGGEIIRLPSEKINGEKNRGEFCEGIAKPASCPVQCFRPDPVCGEDSVTYWCGCADALCHGVRVVKQGACDVGNGVGLSVPGQALLLIHIVWMMLLGFSILFGLF

SEQ ID NO: 712 - protein, 133 aa, Medicago truncatula
  misc_feature: Public GI ID no.144923134
  misc_feature: Bit score of 235.1 for HMM based on sequences of FIGURE 6.
  misc_feature: Functional Homolog Of Ceres SEEDLINE ID no. ME03227 at SEQ ID NO. 711
MAGISAVIIVISIFLMVLVVADDMSSSSLSSSSSSVIRLPSKVTAEGKNVCAGAVASSWCPVKCFRTDPVCGVDGVTYWCGCAEAACAGVKVGKMGFCEVGSGGSAPLSAQAFLLLHIVWLIVLAFSVFFGLF

SEQ ID NO: 713 - DNA, 624 bp, Brassica napus
  misc_feature: Ceres CLONE ID no.964616
  misc_feature: Encodes the peptide sequence at SEQ ID NO 714
aattctcctgtcgttgtttcctttcaagaaaaagagagagagagagagagaggaaataacgtccgtttgaagatccaaatctcggcaatgtcgacgttctcgccatcgttggccgtcctctctctgattcttctgagcctctctctggtttcatcgmcggagattaacaagggaggagagattcgattaccttccgagaagaccaacggtgaattctgcgggaaaacgtctaaaccggcttcgtgtccggttaagtgttttagggctgatccggtttgcggagaagacggcgttacgtactggtgcggttgtgcagatgctctgtgccacggcgttcgtgtctctaaacctggagcttgtgatgttggtaatggcgttgggttgtctgttcctggacaagctctgcttttgatccacattgtctggatgatggctcttgggttttcgatcctctttggcctyttytgattttttttttttgttggggattaagaagatagagattggtaggttttgaggttgcaaccmctgaatctttttgttgataatcattgatataaaatgttgagttttatttcctaattgatgkgcagaaaaaaaaaatgatatgtattgatatattmc

SEQ ID NO: 714 - protein, 126 aa, Brassica napus
  misc_feature: Ceres CLONE ID no.964616
  misc_feature: Bit score of 311.2 for HMM based on sequences of FIGURE 6.
  misc_feature: Functional Homolog Of Ceres SEEDLINE ID no. ME03227 at SEQ ID NO. 711
  misc_feature (24)..(24): Xaa is any aa, unknown, or other
  misc_feature (125)..(125): Xaa is any aa, unknown, or other
  misc_feature (126)..(126): Xaa is any aa, unknown, or other
MSTFSPSLAVLSLILLSLSLVSSXEINKGGEIRLPSEKTNGEFCGKTSKPASCPVKCFRADPVCGEDGVTYWCGCADALCHGVRVSKPGACDVGNGVGLSVPGQALLLIHIVWMMALGFSILFGXX

SEQ ID NO: 715 - protein, 135 aa, Gossypium hirsutum
  misc_feature: Ceres CLONE ID no.100009667
  misc_feature: Bit score of 354.8 for HMM based on sequences of FIGURE 6.
  misc_feature: Functional Homolog Of Ceres SEEDLINE ID no. ME03227 at SEQ ID NO. 711
MPCFTATPFYLLTLFLLFFYFSPQIAQSSPDNSRSIRLPSDGFTIADDNEGVCARFTKPASCPVTCFRTEPVCGVDGVTYWCGCADAYCAGTRVAKSGFCEVGNGGSASVPGQALLLVHIVWLILLGFFVLCGLF

SEQ ID NO: 716 - DNA, 558 bp, Populus balsamifera subsp. trichocarpa
  misc_feature: Ceres ANNOT ID no.1471437
  misc_feature: Encodes the peptide sequence at SEQ ID NO 717
atggcgtcaagactctcaagaccgttgtcgttgttttgttccttttccattcctctaggcataccttttcttggtgttcgccataccaatcgcatcgcccaattccctctcttccacgaattcctctgctttcaaaattcaatagtctgtaacaagaacccattaccccttgcctccgtatccatattttcctatattttagggttagggttagggttaggcctctgcttccagatcgcgcgatcggagcctgacgctgcaatattaattcaagaagtcacgaacaaggatggaaagggtgaagcatgcgcagggttaaaagcacccgcttcatgcccaatcaattgtttccgtgcggatcctgtgtgtggttttgatggtgttacttattggtgtgggtgcgctgacgctatgtgcagtggcactcgtgttgctaaattaggggcttgcgaggttggaagtggtggcagcgcttctctacccggtcaagcacttcttttgattcatattgtctggcttatcttgattgggttttctctcttgtttgggtttttttaa

SEQ ID NO: 717 - protein, 185 aa, Populus balsamifera subsp. trichocarpa
  misc_feature: Ceres ANNOT ID no.1471437
  misc_feature: Bit score of 265.0 for HMM based on sequences of FIGURE 6.
  misc_feature: Functional Homolog Of Ceres SEEDLINE ID no. ME03227 at SEQ ID NO. 711
MASRLSRPLSLFCSFSIPLGIPFLGVRHTNRIAQFPLFHEFLCFQNSIVCNKNPLPLASVSIFSYILGLGLGLGLCFQIARSEPDAAILIQEVTNKDGKGEACAGLKAPASCPINCFRADPVCGFDGVTYWCGCADAMCSGTRVAKLGACEVGSGGSASLPGQALLLIHIVWLILIGFSLLFGFF

SEQ ID NO: 718 - DNA, 390 bp, Populus balsamifera subsp. trichocarpa
  misc_feature: Ceres ANNOT ID no.1444568
  misc_feature: Encodes the peptide sequence at SEQ ID NO 719
atgtcgaaattctcagcaattttcacatgcgtcactattttcttattgagcagtctctgcttcccgatcgcgctatcggaaactggcgctggaatattgattcaagaagtcacaagagaggatggtaagggtgatgcatgcgcaggattaaaagcacccgcttcatgtccgatcaattgtttccgtgcggaccccgtgtgtggcgtcgatggcgttacttattggtgtgggtgcgctgacgctttgtgcagtggcactcgtgttgataaattaggggcttgtgaggttgggagtggagggagctcttctcttcctggtcaggcacttcttttgattcatattgtctggcttatcttgcttgggttttctctcttgtttgggtttttttaa

SEQ ID NO: 719 - protein, 129 aa, Populus balsamifera subsp. trichocarpa
  misc_feature: Ceres ANNOT ID no.1444568
  misc_feature: Bit score of 317.2 for HMM based on sequences of FIGURE 6.
  misc_feature: Functional Homolog Of Ceres SEEDLINE ID no. ME03227 at SEQ ID NO. 711
MSKFSAIFTCVTIFLLSSLCFPIALSETGAGILIQEVTREDGKGDACAGLKAPASCPINCFRADPVCGVDGVTYWCGCADALCSGTRVDKLGACEVGSGGSSSLPGQALLLIHIVWLILLGFSLLFGFF

SEQ ID NO: 720 - DNA, 474 bp, Brassica napus
  misc_feature: Ceres CLONE ID no.1270484
  misc_feature: Encodes the peptide sequence at SEQ ID NO 721
gaacgcgaatcgggcaaattcgatttatagattgcaggaaccaatcgattccacgtgatgccgtcgttctcgtggatcagcatccccttactcttattgctattctgcttgatcggctcacaagctgcggatgatctcccggagaaatcaagcggtggcgtatgcagcggtgtttcggatccgggcgggtgcccaataaactgtttccgggcggatccggtttgcggagccgacggagtcacgtactggtgcgggtgtcccgacgcggcgtgccacggagctcgcgtggtgaaaacgggagcctgcgacgcgggtaacgcgggaagcgcttctgtgccgggtcaagctttgttactcatccatatcgtttggctcttcttgctcggactctctcttctcgtcggtgctttctgaatggattagataaataagaaaattgatcccaattcgtttgtagctttttcttttgtcgtg

SEQ ID NO: 721 - protein, 118 aa, Brassica napus
  misc_feature: Ceres CLONE ID no.1270484
  misc_feature: Bit score of 203.9 for HMM based on sequences of FIGURE 6.
  misc_feature: Functional Homolog Of Ceres SEEDLINE ID no. ME03227 at SEQ ID NO. 711
MPSFSWISIPLLLLLFCLIGSQAADDLPEKSSGGVCSGVSDPGGCPINCFRADPVCGADGVTYWCGCPDAACHGARVVKTGACDAGNAGSASVPGQALLLIHIVWLFLLGLSLLVGAF

SEQ ID NO: 722 - DNA, 660 bp, Glycine max
  misc_feature: Ceres CLONE ID no.1075098
  misc_feature: Encodes the peptide sequence at SEQ ID NO 723
accaagcaattcaaacaacacggtaacacgcaaactccgagaaaatccccaaatcacataaaattagggttacgaatcggggaaagttgtctctcctttcaccctaattcgatgcctataggtttcaggaaccaagtgatgcggtcgttctcgtggatcatcatccctttactcttattgctattctgcttgatcggctcctcacaagcagcggacgagaaatcaagcggcgacgtgtgcaatacggtttcggatccgggcgggtgcccaataaactgtttccgggcggatccggtttgcggagccgacggagtcacgtactggtgcggttgtcccgacgcggcgtgccacggagctcgcgtggtgaaaacgggagcctgcgacgcgggtaacgcgggaagcgcttctgtgccgggtcaagctttgttactgatccatatcgtttggctcttcttgctcggactctctcttctcgtcggtgctttctgaatggattagataataaggaaattgatcccaattcgtttctgtagcttcttcttttgtcgtgatttatagatcagcacttgtgtttgagatgattcatgcttctgtagatcacacgttatgtgtttgtatgtgtaacgttgagttggtttctcttaatggatttgcttcgtc

SEQ ID NO: 723 - protein, 116 aa, Glycine max
  misc_feature: Ceres CLONE ID no.1075098
  misc_feature: Bit score of 198.4 for HMM based on sequences of FIGURE 6.
  misc_feature: Functional Homolog Of Ceres SEEDLINE ID no. ME03227 at SEQ ID NO. 711
MRSFSWIIIPLLLLLFCLIGSSQAADEKSSGDVCNTVSDPGGCPINCFRADPVCGADGVTYWCGCPDAACHGARVVKTGACDAGNAGSASVPGQALLLIHIVWLFLLGLSLLVGAF

SEQ ID NO: 724 - DNA, 772 bp, Glycine max
  misc_feature: Ceres CLONE ID no.719489
  misc_feature: Encodes the peptide sequence at SEQ ID NO 725
attctccaaccaacggcgacaacaacaaagattctttctagtttcttcctttcctttcctttttcgtcgccaacacggtaaacaaaaccccccaaatttcctcaattagggtttcaatccacattccaattccccaaccctcttcttccccatcctccaaatcccgaaactttccccaactgggtcctcaagtacgccacggcgagccctcgtagctcgcgatctcagaaaccaacgatgccgaaatcctcacgattcctcgtcgtcgcgatcgccgtcgccgcgctctgcgtgatcctccccgtcgcggcggcggcggatctcgaggaccccggcgtgctgcggctgccgtcggacagcctgtgcggcaaaacgacgccgtcttcgtgcccggcaaagtgcttccgcgccgaccccgtttgcggcgcggacggcgtgacgtactggtgcggttgcgcagaggcggcgtgcgcaggcgtggaggttgcgaaattggggttctgtgaagtcgggaatggtggctcggcgccgattcctgggcaagctctgcttttggtgcacattgtttggctcattgtgttggggttctccgtgttgttcggtcttttttagataattgggtttctttatgtatctaccatgatcagagggtgttatggttttggttctttgggattctttgagggttctttttgtaaattgatcaaacggccattcttgtattgtatgtatgattattcttattattgtaatttcacaactttcttgattc

SEQ ID NO: 725 - protein, 124 aa, Glycine max
  misc_feature: Ceres CLONE ID no.719489
  misc_feature: Bit score of 306.0 for HMM based on sequences of FIGURE 6.
  misc_feature: Functional Homolog Of Ceres SEEDLINE ID no. ME03227 at SEQ ID NO. 711
MPKSSRFLVVAIAVAALCVILPVAAAADLEDPGVLRLPSDSLCGKTTPSSCPAKCFRADPVCGADGVTYWCGCAEAACAGVEVAKLGFCEVGNGGSAPIPGQALLLVHIVWLIVLGFSVLFGLF

SEQ ID NO: 726 - protein, 357 aa, Populus balsamifera subsp. trichocarpa
  misc_feature: Ceres ANNOT ID no.1451912
  misc_feature: Bit score of 603.5 for HMM based on sequences of FIGURE 9.
  misc_feature (117)..(351): Pfam Name: Trehalose_PPase Pfam Description: Trehalose-phosphatase
  misc_feature: Functional Homolog Of Ceres SEEDLINE ID no. ME20095 at SEQ ID NO. 1129
MTNQNVVVPNARKGVDITITMALSKSLFSPVVPKPLPAAPGGYFTISRKMFAKKTETGGKTNSWADSMRDSSPTRVKSTTSLSEIEEKNTWIVNHPSALNMFEQIVNGSKGKQIVMFLDYDGTLSPIVEDPDRAFMTNEMREAVRDVARYFPTAIVTGRCRDKVYSFVRLAGLYYAGSHGMDIKGPSKNCCRNKKDYQGVLFQPASDFLPMIDEVYNALLERTKYIPGARVEDNKFCISVHFRCVEEKMWAALVEQVRSVLNGYPKLRLTQGRKVLEIRPTIKWDKGKALEFVLESLGYANSTDVLPVYIGDDRTDEDAFKVLRNRGQGLGILVSKVPKETNASYSLQEPTEASSLI

SEQ ID NO: 727 - protein, 117 aa, Arabidopsis thaliana
  misc_feature: Public GI ID no.18412211
  misc_feature: Bit score of 189.0 for HMM based on sequences of FIGURE 6.
  misc_feature: Functional Homolog Of Ceres SEEDLINE ID no. ME03227 at SEQ ID NO. 711
MPSLTLSIRFLFLVLCLIGLQAADDFPDKSRGDVCPRVKDRGGCTINCFRADPVCGTDGVTYWCGCPDAACHGARVVKKGACDTGNAGSASVPGQALLLIHIVWLFLLGLSLLVGGF

SEQ ID NO: 728 - DNA, 701 bp, Arabidopsis thaliana
  misc_feature: Ceres CLONE ID no.20358
  misc_feature: Encodes the peptide sequence at SEQ ID NO 729
aaaacaacacggttacgcaaactctctctgagaaaatccccaaatctcatgaaattagggtttcaatcattctttgaacgcaaaattagaaacctcctctccatccgccacgaatctctagggttcttctgaaggattagatttctgggttttagaaatctgtctctcgtcatcaacaattcacgtgatgccgtcgttaacactgagcattcgtttccttttcttagttctctgcttgatcggtttacaagctgcggatgatttcccagataaatcccgcggtgacgtatgccctcgggttaaggatcggggtggatgcacaatcaactgtttccgggcggatccggtttgtggaaccgatggagtcacgtactggtgcggttgtcccgacgcagcttgccatggcactcgcgtagtcaaaaaaggagcttgtgacacaggtaatgcaggaagtgcttctgttcctggacaagctttgttattgattcatattgtttggctcttcttgctcggactctctcttctcgttggtggtttctgatctctagagagttagtggtggaattagacaaggaattagatagatcacacgtcctgagtttgttgtatgtgtatagttgagtattgttttgctttgtgtgctatatatatgtaatagattctgttgcagttcattctaataatgaagatttgatcggacg

SEQ ID NO: 729 - protein, 117 aa, Arabidopsis thaliana
  misc_feature: Ceres CLONE ID no.20358
  misc_feature: Bit score of 190.1 for HMM based on sequences of FIGURE 6.
  misc_feature: Functional Homolog Of Ceres SEEDLINE ID no. ME03227 at SEQ ID NO. 711
MPSLTLSIRFLFLVLCLIGLQAADDFPDKSRGDVCPRVKDRGGCTINCFRADPVCGTDGVTYWCGCPDAACHGTRVVKKGACDTGNAGSASVPGQALLLIHIVWLFLLGLSLLVGGF

SEQ ID NO: 730 - DNA, 627 bp, Gossypium hirsutum
  misc_feature: Ceres CLONE ID no.1915503
  misc_feature: Encodes the peptide sequence at SEQ ID NO 731
agttgcagcaaatcctttcaatcacgacacatatgccgtgcttcacggcaattcagctaaacatcctaaccgtcctcctcttcttctgtttctgggcgccgatcgcgcgatccttgccggataattcgggatctatccggttaccttccgacggatttacaaacgccgatgagaacgaaggcgtctccgctcgattcaataagccgtcatcctgcccggtcaattgcttccgaacggagcccgtttgcggcgttaatggcgtcacctactggtgcggtcgcgccgatgcattatgtgccggtactcgcgtggccaaagtaggattttgtgaggtcgggagcggaggtagcgcgtcgtttcctggtcaggctctgcttttggttcatattgtttggctcgtcttgcttggcttttctgtattgtgtggtcttttctaatttttccaaacagagacttttttttgtgtgtgttatttttcctctctcggattctatctgtattctatttgcctaccatgtcattttctcatctgtattactgtaaatcatattctttgtagtaatataccaatttggttctcctttcattataatatcaactattcaccaaaaaaaaaaaaaaaaaaaa

SEQ ID NO: 731 - protein, 134 aa, Gossypium hirsutum
  misc_feature: Ceres CLONE ID no.1915503
  misc_feature: Bit score of 279.5 for HMM based on sequences of FIGURE 6.
  misc_feature: Functional Homolog Of Ceres SEEDLINE ID no. ME03227 at SEQ ID NO. 711
MPCFTAIQLNILTVLLFFCFWAPIARSLPDNSGSIRLPSDGFTNADENEGVSARFNKPSSCPVNCFRTEPVCGVNGVTYWCGRADALCAGTRVAKVGFCEVGSGGSASFPGQALLLVHIVWLVLLGFSVLCGLF

SEQ ID NO: 732 - DNA, 802 bp, Glycine max
  misc_feature: Ceres CLONE ID no.587748
  misc_feature: Encodes the peptide sequence at SEQ ID NO 733
gttaatttcttaacccatcttccaagcattcttatccgacaaggattcctttctctctctcttgatccaatcttttcgtccattaaaattaggattttaaattctcaattttcaattttcaactccaatccctccggcgagctttccaggaagctcgcttctctccgaccatggccggaatcaccaaaacctctcacttttccgtcgttttgatcgccgtcgtcgccctctgcgtcttcccggcagcgacatccgataacgtggcctcggcggtcctcgggttgccgtcccatgtcgctggcgaaggaaagaacttgtgcagcgcggcagcgccgtcgtcgtgtcccgtgaagtgtttccgaaccgacccggtttgcagcgtggacggcgtgacgtactggtgcgggtgcagcgaagccgcgtacgccagcgcacagattgcgaaattggggttctgtgaagtggggaatggcggctccgtcactctttctggtcaggcattgcttctggtgcacattgtgtggctcatcgtgttaggcttctccgtcttctttggtctcttttaatttttttaatgctgagagctgaggagcaaacgtaacacaatacatacacactcatgtctctcactttacaatgatgtaatagctgtttttggtattatgtagcactaggagtttcacaacgttatttaattcagaaattaaaatactttggcctcttacgggagatactagctagcttttattgattgattcgctgaaaatgcagatttacatttttgtcactgttcattcgattt

SEQ ID NO: 733 - protein, 131 aa, Glycine max
  misc_feature: Ceres CLONE ID no.587748
  misc_feature: Bit score of 306.2 for HMM based on sequences of FIGURE 6.
  misc_feature: Functional Homolog Of Ceres SEEDLINE ID no. ME03227 at SEQ ID NO. 711
MAGITKTSHFSVVLIAVVALCVFPAATSDNVASAVLGLPSHVAGEGKNLCSAAAPSSCPVKCFRTDPVCSVDGVTYWCGCSEAAYASAQIAKLGFCEVGNGGSVTLSGQALLLVHIVWLIVLGFSVFFGLF

SEQ ID NO: 734 - protein, 132 aa, Oryza sativa subsp. indica
  misc_feature: Public GI ID no.125528114
  misc_feature: Bit score of 305.0 for HMM based on sequences of FIGURE 6.
  misc_feature: Functional Homolog Of Ceres SEEDLINE ID no. ME03227 at SEQ ID NO. 711
MPPSYTPTARLRLLVLFLASLSLLFAQTLASSSAAASAEAEVSDPCAAPVSDGGSEAQLCPVRCFRPDPVCGADGVTYWCGCPEAACAGARVARRGYCEVGAGSAPVSGQALLLVHIVWLFVLGAAVLLGFL

SEQ ID NO: 735 - protein, 128 aa, Oryza sativa subsp. japonica
  misc_feature: Public GI ID no.115440619
  misc_feature: Bit score of 292.4 for HMM based on sequences of FIGURE 6.
  misc_feature: Functional Homolog Of Ceres SEEDLINE ID no. ME03227 at SEQ ID NO. 711
MPPSYTPTARLRLLVLFLASLSLLFAQTLASSSAEAEVSDPCAAPVSDGGSEAQLCPVRCFRPDPVCGADGVTYWCGCPEAACAGARVARRGYCEVGAGSAPVSGQALLLVHIVWLFVLGAAVLLGFL

SEQ ID NO: 736 - DNA, 967 bp, Zea mays
  misc_feature: Ceres CLONE ID no.274172
  misc_feature: Encodes the peptide sequence at SEQ ID NO 737
aattgctattctggggcaaggcgaaatggaacaagagcaagcggccaaccgccagcccaacgccaacgcggtccagccaagtccaacccgtacccaccacgccgccgacgccgacgcgtcgccaacgggaacttctcaaagcgccgacggggtccaccgcgcccgttatttcatcaatcgactcaactaccgcggcctcctcctcgcagaccccgaaggccgccgtgcctcccgccccgcccctcgccggcgaccatcggccgccggcgacacccggcatgccgcccgcccgcttcgtccacctcatcctcctcgcgacgctttcgctcctcctcgcgcagaccctggcctcctcgtcccccgcgcccgcctccgccgccacggcgggggagcccggcgacccctgcgcggccgccgtcgcggacggggacggcgacgtcccgctgtgcccggtgcggtgcttccggccggacccggtctgcggcgccgacggggtcacgtactggtgcggctgccccgaggcagcatgcgcgggcgcccgcgtggctcggcgcggctactgcgaggtcggcgccggctccgcgcccgtctcgggccaggcgctgctgctcgtccacatcgtctggctcttcgtgctcggcgccgccgtcctcctcggcttcctttgatgctctccgtctttcccgcccgttcccgcaggtgtattcccctacccgtaatcactgtcccgatctttgtgttggctctttcctgtgctgctgagggctcaggaatggtgatctggcgatttcgtcgagaggactcgtctagagatgtaactcggttctttgaacttctttctcagatatgttgggatcagctgtgctctacattttggagcagagctgtgatgattggttgttaaatgctgtagattgagattatgtaaaaacagttgtaaattctttgctaacaaattgcattgatc

SEQ ID NO: 737 - protein, 129 aa, Zea mays
  misc_feature: Ceres CLONE ID no.274172
  misc_feature: Bit score of 283.3 for HMM based on sequences of FIGURE 6.
  misc_feature: Functional Homolog Of Ceres SEEDLINE ID no. ME03227 at SEQ ID NO. 711
MPPARFVHLILLATLSLLLAQTLASSSPAPASAATAGEPGDPCAAAVADGDGDVPLCPVRCFRPDPVCGADGVTYWCGCPEAACAGARVARRGYCEVGAGSAPVSGQALLLVHIVWLFVLGAAVLLGFL

SEQ ID NO: 738 - protein, 129 aa, Oryza sativa subsp. japonica
  misc_feature: Public GI ID no.125572387
  misc_feature: Bit score of 186.3 for HMM based on sequences of FIGURE 6.
  misc_feature: Functional Homolog Of Ceres SEEDLINE ID no. ME03227 at SEQ ID NO. 711
MPPSYTPTARLRLLVLFLASLSLLFAQTLASSSAEAEVSDPCAAPVSDGGSEAQLCPVRCFRAGTRSAAPTGSRTGAGAPRPACAGARVARRGYCEVGAGSAPVSGQALLLVHIVWLFVLGAAVLLGFL

SEQ ID NO: 739 - DNA, 396 bp, Sorghum bicolor
  misc_feature: Ceres ANNOT ID no.6015812
  misc_feature: Encodes the peptide sequence at SEQ ID NO 740
atgccgccctcccgcctcgtccacctcatcctcctcgccacgctctcgctcctcctcgcgcaaaccctagccacctcttcccccacgcccgccgccgcgtcggcggcggcggaggcggagtccggcgacccctgcgcggccgccgtcgcggacggggacggagacgtcccgctgtgcccggtgcggtgcttccgcccggacccggtctgcggcgccgacggggtcacgtactggtgcggctgccccgaggcgacctgcgcgggggcccgcgtggcgcgccgcggctactgcgaggtcggcgccggctccgcgcccgtctcgggccaggcgctgctgctcgtccacatcgtctggctcttcgtgctcggcgccgccgtcctcctcggcttcctctga

SEQ ID NO: 740 - protein, 131 aa, Sorghum bicolor
  misc_feature: Ceres ANNOT ID no.6015812
  misc_feature: Bit score of 267.1 for HMM based on sequences of FIGURE 6.
  misc_feature: Functional Homolog Of Ceres SEEDLINE ID no. ME03227 at SEQ ID NO. 711
MPPSRLVHLILLATLSLLLAQTLATSSPTPAAASAAAEAESGDPCAAAVADGDGDVPLCPVRCFRPDPVCGADGVTYWCGCPEATCAGARVARRGYCEVGAGSAPVSGQALLLVHIVWLFVLGAAVLLGFL

SEQ ID NO: 741 - protein, 370 aa, Sorghum bicolor
  misc_feature: Ceres ANNOT ID no.6017545
  misc_feature: Bit score of 867.1 for HMM based on sequences of FIGURE 9.
  misc_feature (116)..(350): Pfam Name: Trehalose_PPase Pfam Description: Trehalose-phosphatase
  misc_feature: Functional Homolog Of Ceres SEEDLINE ID no. ME20095 at SEQ ID NO. 1129
MDMSSSSPVITDPISISPPLLGGLTSNLMPFSVMSGGCSSPSMTASRRKIEEVLVNGLLDAMKSSSPRKKHNLAFGQDNSLDEDPAYSAWLSKCPSALTSFKQIVANAQGRRIAVFLDYDGTLSPIVDDPDKAFMSPVMRAAVRNVAKYFPTAIVSGRSRKKVSEFVQLKELYYAGSHGMDIVTSVAAHATEKCKQANLFQPACEFLPMIDEVSKSLLEVTSGIEGARVENNKFCVSVHYRNVAEKDWKVVAGLVKQVLEAFPRLKVTNGRMVLEVRPVIDWDKGKAVEFLLQSLGLNDSEDVIPIYIGDDRTDEDAFKVLRERKCGYGILVSQVPKDTTEAFYSLRDPSEVMGFLNSLVRWKKHSLRRN

SEQ ID NO: 742 - protein, 161 aa, Arabidopsis thaliana
  misc_feature: Ceres SEEDLINE ID no.ME04477
  misc_feature: Bit score of 409.1 for HMM based on sequences of FIGURE 7.
  misc_feature (102)..(142): Pfam Name: zf-AN1 Pfam Description: AN1-like Zinc finger
  misc_feature (13)..(37): Pfam Name: zf-A20 Pfam Description: A20-like zinc finger
MAEEHRCETPEGHRLCVNNCGFFGSSATMNLCSNCYGDLCLKQQQQASMKSTVESSLSPVIAPVLENYAAELEIPTTKKTEEKKPIQIPTEQPSPPQRPNRCTVCRKRVGLTGFMCRCGTTFCGSHRYPEVHGCTFDFKSAGREEIAKANPLVIAAKLQKI

SEQ ID NO: 743 - protein, 172 aa, Vitis vinifera
  misc_feature: Public GI ID no.147783026
  misc_feature: Bit score of 368.7 for HMM based on sequences of FIGURE 7.
  misc_feature (113)..(153): Pfam Name: zf-AN1 Pfam Description: AN1-like Zinc finger
  misc_feature (15)..(39): Pfam Name: zf-A20 Pfam Description: A20-like zinc finger
  misc_feature: Functional Homolog Of Ceres SEEDLINE ID no. ME04477 at SEQ ID NO. 742
MESHDETGCQAPEGPILCINNCGFFGSAATMNMCSKCHKDLALKQEQAKLAASSIGSIVNGSSSGNGKEPIVAGTVDVQAGPVEVKAISAEASNDSSSNQIIESKVKEGPNRCTACRKRVGLTGFNCKCGNLFCAVHRYSDKHDCPFDYRTAARDAIAKANPVVKAEKLDKI

SEQ ID NO: 744 - protein, 171 aa, Citrus cv. Shiranuhi
  misc_feature: Public GI ID no.119367488
  misc_feature: Bit score of 347.5 for HMM based on sequences of FIGURE 7.
  misc_feature (112)..(152): Pfam Name: zf-AN1 Pfam Description: AN1-like Zinc finger
  misc_feature (15)..(39): Pfam Name: zf-A20 Pfam Description: A20-like zinc finger
  misc_feature: Functional Homolog Of Ceres SEEDLINE ID no. ME04477 at SEQ ID NO. 742
MESHDETGCQAPEGPILCVNNCGFFGSAATMNMCSKCHKAMILNQEQAQLAASSIGSIVHGSSGGTGKEPIIAGSVDLQVGPVEIKKFSMEPSSGSSFGFAGVKAKEGPKRCTTCNKRVGLTGFNCRCGNLFCAVHRYSDKHGCPFDYRTAAREAIAKANPVVKAEKLDKI

SEQ ID NO: 745 - protein, 172 aa, Vitis vinifera
  misc_feature: Public GI ID no.147860340
  misc_feature: Bit score of 328.4 for HMM based on sequences of FIGURE 7.
  misc_feature (113)..(153): Pfam Name: zf-AN1 Pfam Description: AN1-like Zinc finger
  misc_feature (15)..(39): Pfam Name: zf-A20 Pfam Description: A20-like zinc finger
  misc_feature: Functional Homolog Of Ceres SEEDLINE ID no. ME04477 at SEQ ID NO. 742
MDHNETGCQAPPEAPILCINNCGFFGSAATMNMCSKCHKDLVLKQEQAKLAASSFESIVEGSSNCNAKESMVAIAKADIIQTGPSESMPVPTQAACASPSETNDRVKEGPNRCSSCRKRVGLTGFNCRCGNIFCAVHRYSDKHACPFDYRTAARDAIAKSNPVIKPEKLDKI

SEQ ID NO: 746 - protein, 126 aa, Brassica napus
  misc_feature: Ceres Clone ID no. 964616
  misc_feature (1)..(126): Bit score of 321.1 for hmm based on sequences of FIGURE 6.
  misc_feature: Functional Homolog Of SEQ ID NO. 711
MSTFSPSLAVLSLILLSLSLVSSTEINKGGEIRLPSEKTNGEFCGKTSKPASCPVKCFRADPVCGEDGVTYWCGCADALCHGVRVSKPGACDVGNGVGLSVPGQALLLIHIVWMMALGFSILFGLF

SEQ ID NO: 747 - protein, 131 aa, Picea sitchensis
  misc_feature: Public GI ID no. 116784747
  misc_feature (1)..(131): Bit score of 212.2 for hmm based on sequences of FIGURE 6.
  misc_feature: Functional Homolog Of SEQ ID NO. 711
MAGYVQPGLVLILLFLITNTLFGAALSGPESEIAIALPSEGNTRRLSVCSEKNESASCPVSCFRPDPVCGVDGITYWCGCTDAQCAGVDVAKIGFCEVGNGGSGLLSGEALLLVHIVWLILLGFIVLIGVP

SEQ ID NO: 748 - protein, 173 aa, Gossypium hirsutum
  misc_feature: Ceres CLONE ID no.1793946
  misc_feature: Bit score of 350.2 for HMM based on sequences of FIGURE 15.
  misc_feature (114)..(154): Pfam Name: zf-AN1 Pfam Description: AN1-like Zinc finger
  misc_feature (18)..(42): Pfam Name: zf-A20 Pfam Description: A20-like Zinc finger
  misc_feature: Functional Homolog Of Ceres SEEDLINE ID no. ME02401 at SEQ ID NO. 749
MAQRTEKEETEFKVPETLTLCVNDCGVIGNPATNNMCQNCFNATTPKSTAAVVSSSTGGASSGGVSILNQRSTTSRSINKRSDLSPPKTTTFVRSSGSRNDPEPGTEKKVVNRCSGCRKRVGLTGFRCRCGELFCADHRYSDRHDCSYDYKTVGREAIARENPVVKAAKIIKV

SEQ ID NO: 749 - protein, 160 aa, Arabidopsis thaliana
  misc_feature: Ceres SEEDLINE ID no.ME02401
  misc_feature (101)..(141): Pfam Name: zf-AN1 Pfam Description: AN1-like Zinc finger
  misc_feature (23)..(47): Pfam Name: zf-A20 Pfam Description: A20-like zinc finger
  misc_feature: Bit score of 407.3 for HMM based on sequences of FIGURE 15.
MAQRTEKEETEFKVLETLTTTTTTLCTNNCGVTANPATNNMCQKCFNASLVSAAAGVVESGSILKRSARSVNLRSSPAKVVIRPREIDAVKKRDQQIVNRCSGCRKKVGLTGFRCRCGELFCSEHRYSDRHDCSYDYKTAGREAIARENPVVKAAKMVKV

SEQ ID NO: 750 - DNA, 870 bp, Zea mays
  misc_feature: Ceres Clone ID no. 273507
  misc_feature: Encodes the peptide sequence at SEQ ID NO. 751
acccaccacgtcgtcgacgccgacgcgtcgccaacggaaacttctcaaagcgccgacggggttccacggcgcccgtaatttcaaccgtccccaccgccgcgggctcctcctgacggaccccgaaggtcgccgtgactcccgcccctcgccggcgacgtccggcatgccgtcctcccgcctcttccgcctcttcctcctcgcgacgctctcgctcctcctcgcgcaaaccctagcctcctctgcccccgtgcccgccgccgcgtcggcgtcggcggagtccaccgacccctgcgcggccgccgtagctgacggggaagctgacgttccgctgtgccccgtgcggtgcttccgcccagacccggtctgcggcgccgacggggtcacgtactggtgcggctgccccgaggcgacctgcgcgggcgcccgcgtggcgcgacgcggctactgcgaggtcggcgccggctccggctccgcgcccgtctcgggccaggcgctgctgctcgtccacatcgtctggctcttcgtgctcggcgccgccgtcctcctcggtttcctctgatgcgcctctcgcgttcccgcagttgtattcccctcccccatattctttgtcccgatcttctgttggttcttgtcttcttgttgtgctgttgatggctgaggaattgcgatgtaacgatttagttgtaattttgagaggatccgtctagagatgtaacccggttcttcgtcagatctgtcgggttcagctgtgctcaacacttcgaagcagagctgcgatgattggttgtcaaatgttgtaggttgaggtcatgtaaaacagttgtaaattcctcattaacgaatcgcattgatcagattgttttgttgtcc

SEQ ID NO: 751 - protein, 131 aa, Zea mays
  misc_feature: Ceres Clone ID no. 273507
  misc_feature (1)..(131): Bit score of 252.2 for hmm based on sequences of FIGURE 6.
  misc_feature: Functional Homolog Of SEQ ID NO. 711
MPSSRLFRLFLLATLSLLLAQTLASSAPVPAAASASAESTDPCAAAVADGEADVPLCPVRCFRPDPVCGADGVTYWCGCPEATCAGARVARRGYCEVGAGSGSAPVSGQALLLVHIVWLFVLGAAVLLGFL

SEQ ID NO: 752 - protein, 126 aa, Vitis vinifera
  misc_feature: Public GI ID no. 157355175
  misc_feature (1)..(126): Bit score of 210.5 for hmm based on sequences of FIGURE 6.
  misc_feature: Functional Homolog Of SEQ ID NO. 711
MEFNRSRLLSSFVVIFIVFAICFPPTVTSSVIRLPSDAVDGESDGGLCGGSEVAASCPVKCFRPDPVCGVDGVTYWCGCTEARCAGTAVAHFGICEVGNGSAGQALLLVHIVWLMVLGFSVLFGLF

SEQ ID NO: 753 - protein, 496 aa, Vitis vinifera
  misc_feature: Public GI ID no. 157341912
  misc_feature (1)..(496): Bit score of 759.0 for hmm based on sequences of FIGURE 11.
  misc_feature (33)..(209): Pfam Name: HSF_DNA-bind Pfam Description: HSF-type DNA-binding
  misc_feature: Functional Homolog Of SEQ ID NO. 364
MEGASGSSSAVNSGGGGGGAPPPHPIPNSNAPPPFLSKTYDMVDDPATNSIVSWSPTNNSFVVWNPPEFARDLLPKYFKHNNFSSFVRQLNTYGFRKVDPDRWEFANEGFLRGQKHLLRSINRRKPAHGHNLQQPQQSHSQGSSVGACVEVGKFGLEEEVERLKRDKNVLMQELVRLRQQQQTTDNQLQTMVQRLQGMEQRQQQMMSFLAKAVQSPGFLAQFVQQQNESNRRITEANKKRRLKREDTAEGEHSAAPSDGQIVKYQPLMNEATKAMLRQMVKMDTSAFSNDSDNFLIGDVSSSSNGVEKGGSSTCVSGVTLQEVPPTSLPVASGVPSHDPPSAPISEIQSPPDICALVGAQEAVPISIALPDVILPELSQIPEMLPKSIVDIHKDDYVGPQSGNVEFMDPISLGIDGAMPIDIDNISADPDIDALLDASSNFWEDLLVDNDEVESTPLEDTTKGNEMQPSENGWDKAQHMAKLTEQMGLLTSDTKRI

SEQ ID NO: 754 - protein, 361 aa, Vitis vinifera
  misc_feature: Public GI ID no. 157339268
  misc_feature (1)..(361): Bit score of 690.6 for hmm based on sequences of FIGURE 11.
  misc_feature (27)..(194): Pfam Name: HSF_DNA-bind Pfam Description: HSF-type DNA-binding
  misc_feature: Functional Homolog Of SEQ ID NO. 364
MGSSSSSSSSPGFAPHPLEGLHEVGPPPFLTKTFDMVEDPATDSVVSWSRARNSFIVWDSHKFSTTLLPRYFKHSNFSSFIRQLNTYGFRKVDPDRWEFANEGFLGGQKHLLKNIKRRRHVSQNTQQGGLGACVELGQYGLEDELERLKRDRNVLMAEIGKLRQQQQNSRNELVAMEGRMQNTEKKQMQMMTFLAKALNNPSFVQQFIQQRRELRGAEIGRKRRLTTSQSAENLQEVITVASIDQAFSYTNQDDGDMSGIESEIETFFSGGWDNESSEDIKDPKADSIDNNLGSVNDVIWEELLSDDLIAGNEEEVPPLRLGDHHEPETDVEVEDLVATPSDWGEDFQDLVDQMAFLRSKS

SEQ ID NO: 755 - protein, 361 aa, Vitis vinifera
  misc_feature: Public GI ID no. 157348009
  misc_feature (1)..(361): Bit score of 502.0 for hmm based on sequences of FIGURE 11.
  misc_feature (39)..(207): Pfam Name: HSF_DNA-bind Pfam Description: HSF-type DNA-binding
  misc_feature: Functional Homolog Of SEQ ID NO. 364
MNPMYPVKEEFPGSSSSPQSGEPPVVPQPVEGLHDAGPPPFLTKTFDIVDDPASDHVVSWSRAGSSFVVWDPHAFSTNLLPKNFKHNNFSSFVRQLNTYGFRKIDPDRWEFANEGFIRGQRHLLKNIRRRKTPSQAPPPHQALDPCVEVGRFGLDGEVDRLQRDKHVLMMELVKLRQQQQNTRITLQAMEQRLQGTEIKQQQMMNFLARAMQNPAFIQQLVQQKERRKEIVEAISKKRRRPIDQGTSGAGGTESSHGNGLRNPIKIEPLHFTEGNGFEVSELEALAFEMQGLGRPRKELEDHEELDPPESEDKELDEGFWEELLNERFGCPSSLPGAEGEEEEEDVNVLAGRFGYLGSSPQ

SEQ ID NO: 756 - protein, 306 aa, Carex stenophylla subsp. stenophylloides
  misc_feature: Public GI ID no. 151303349
  misc_feature (1)..(306): Bit score of 450.9 for hmm based on sequences of FIGURE 11.
  misc_feature (32)..(202): Pfam Name: HSF_DNA-bind Pfam Description: HSF-type DNA-binding
  misc_feature: Functional Homolog Of SEQ ID NO. 364
MDPVKVKNEVLVQPAHGPAPGPMESLHEGGPPPFLRKTYEIVDDPSTNQVVSWGPAGNSFVVWDPHQFATTLLPRYFKHGNFSSFVRQLNTYGFRKIDPDKWEFANEGFFHGQRNLLKSIKRRKSPANISAIQQSQPLDQCLELGQFGPEQEIDRLKRDKNTLIAEVIKLRQEHIVTRSHVQAMEEKLEDAEKKQHQVMGFLARAMQNPTFLQQLAQQHEKRKEIEEAISKKRRRPIEAGSSSTQCPPLFGEIGTGAGAFREDGELENDFWEELLQDEMVKEEADVENDVEALARQLGYMTSHRPE

SEQ ID NO: 757 - protein, 170 aa, Oryza sativa subsp. japonica
  misc_feature: Public GI ID no.115477170
  misc_feature: Bit score of 345.0 for HMM based on sequences of FIGURE 7.
  misc_feature (111)..(151): Pfam Name: zf-AN1 Pfam Description: AN1-like Zinc finger
  misc_feature (19)..(43): Pfam Name: zf-A20 Pfam Description: A20-like zinc finger
  misc_feature: Functional Homolog Of Ceres SEEDLINE ID no. ME04477 at SEQ ID NO. 742
MAQREKKVEEPTELRAPEMTLCANSCGFPGNPATNNLCQNCFLAASASSSSSSAAASPSTTSLPVFPVVEKPRQAVQSSAAAAVALVVERPTAGPVESSSKASRSSSVNRCHSCRRRVGLTGFRCRCGELYCGAHRYSDRHDCSFDYKSAARDAIARENPVVRAAKIVRF

SEQ ID NO: 758 - DNA, 586 bp, Papaver somniferum
  misc_feature: Ceres CLONE ID no.1620215
  misc_feature: Encodes the peptide sequence at SEQ ID NO 759
atctccaaaacaatcaaaaatctgcaaaaaaaaaaaaaatcatttctcaaattctactcagattcatggctcagagagataaagaagaaacagaaatgaaggtttctgaatccttatcactttgcatcaacaactgtggtttctcaggtaatccggctaccaagaacatgtgtcaaagttgttacaaaatttctaccgggattatgacacaaccggctctgacgttttccggcaaagaaaaggctagatctagctttctgaggttgccggagcgatcggattatcaacgacgagatctgattacgcaggatgataagaaaggaattgatgatgatcaagcgaagaatgattcgacgacaattaagattgttgagaagaagcaagaggtgaatcggtgttcaggttgccggaggaaagtaggattgaccggatttagatgtcggtgcggtgatatgttctgttcggaacatagatattccgatcgacatgactgtagttttgattataaagctgctggtagagagagtattgctcgccagaatcctgtcgttaaagctgctaagattattagactctaaattaatgt

SEQ ID NO: 759 - protein, 170 aa, Papaver somniferum
  misc_feature: Ceres CLONE ID no.1620215
  misc_feature: Bit score of 293.8 for HMM based on sequences of FIGURE 7.
  misc_feature (111)..(151): Pfam Name: zf-AN1 Pfam Description: AN1-like Zinc finger
  misc_feature (17)..(41): Pfam Name: zf-A20 Pfam Description: A20-like zinc finger
  misc_feature: Functional Homolog Of Ceres SEEDLINE ID no. ME04477 at SEQ ID NO. 742
MAQRDKEETEMKVSESLSLCINNCGFSGNPATKNMCQSCYKISTGIMTQPALTFSGKEKARSSFLRLPERSDYQRRDLITQDDKKGIDDDQAKNDSTTIKIVEKKQEVNRCSGCRRKVGLTGFRCRCGDMFCSEHRYSDRHDCSFDYKAAGRESIARQNPVVKAAKIIRL

SEQ ID NO: 760 - protein, 398 aa, Vitis vinifera
  misc_feature: Public GI ID no. 157342621
  misc_feature (1)..(398): Bit score of 365.4 for hmm based on sequences of FIGURE 11.
  misc_feature (68)..(233): Pfam Name: HSF_DNA-bind Pfam Description: HSF-type DNA-binding
  misc_feature: Functional Homolog Of SEQ ID NO. 364
MESVEVKEESMWVEVEDSGELWGSSVAAKEEKMLEADGGGESGWCCSSLAAAAEVAKPMEGLHEAGPPPFLKKTFEMVEDPETDSVVSWSVARNSFIVWDSHNFSQSLLPKYFKHSNFSSFIRQLNTYGFRKIDSDRWEFANEAFQGGKRHLLKNIKRRRHGCLQQQGSRSGAESVKLQLEAEVESLRKDQNILNVEILRMRQRQETSQNHLTAVEERIRGAECKQKQMFIFMAKAVKNPSFVQQLIQKRQKRELGDGEIGKKRRLASMLSVGSLLEAIFSNQTVHYRNQNLVQEEPSLQSEIQSLFCSGIDDESGGSPPEDQEANVISGTGNPDLLSFNNGMLEKLMEEDPICQNEAEELLSGKPSILDFELEEWIEKPVDWSVYVKELMEPQFGCV

SEQ ID NO: 761 - protein, 161 aa, Gossypium hirsutum
  misc_feature: Ceres CLONE ID no.1931889
  misc_feature: Bit score of 394.0 for HMM based on sequences of FIGURE 7.
  misc_feature (102)..(142): Pfam Name: zf-AN1 Pfam Description: AN1-like Zinc finger
  misc_feature (13)..(37): Pfam Name: zf-A20 Pfam Description: A20-like zinc finger
  misc_feature: Functional Homolog Of Ceres SEEDLINE ID no. ME04477 at SEQ ID NO. 742
MAEEHRCQAPEGHRLCVNNCGFFGNSATMNLCSKCYRDLCLKEQEASSIKSALSSSPSSSSTVVESISQVPLLALPEVNRESAVPEIAPAAEQLSQQQPNRCMVCRKRVGLTGFRCKCGVTFCGSHRYPENHGCTFDFKKVGREEIARANPLVKAGKLEKI

SEQ ID NO: 762 - DNA, 915 bp, Gossypium hirsutum
  misc_feature: Ceres CLONE ID no.1798756
  misc_feature: Encodes the peptide sequence at SEQ ID NO 763
gatctttctgataatcctttcctttgttcatattctccctttctgcttcttatttattttctttcaccttttcctttcaagatcgagagaaaaaagaatggcagaggagcatagatgccaagcgccagaaggccatcgtctttgcgtcaataactgcggctttttcggaagttcggcgacgatgaacctttgctccaaatgttacagagatctctgtctcaaggaacaggaagcttcttcgatcaaatccgctctttcctcttccccttcgtcttcatcaacggtcgtcgaatccatttctcaggttcctcttttggctctccatgaagtcaacagagaatcggcggttccggagattgcatcggcggccgaacagcgatcgcagcaacaaccgaatcggtgcatggtttgcaggaagcgggtcgggttgaccggattcagatgcaagtgcggtgttacgttttgtgggtcccacaggtaccctgagaatcacgggtgtacgttcgatttcaagaaggtcggcagagaggagatagcacgcgctaatcccctcgtcaaagcagagaagctcgagaagatttgagtagaagatgatgatgatgggaagccaagccattgggaaaatttcaaatttcatcaaacgttgataaggtcgagacacgtgtttcggaggtggtccctaccaccaagagtaaaccaattgggctggataaatatattttcttcttaaaatataaatattttataataatatttaaattatgtgcctctttagttttttttttttctcttcctcttttgctttgtaaaaaaaaaaaaagtcactttttcttttcttcttttaatcccttgtggtgaaaaaaagaaaaagaaatgtagattcctgcttcttccaaaaaaaaaaaaaaaaaaaaa

SEQ ID NO: 763 - protein, 161 aa, Gossypium hirsutum
  misc_feature: Ceres CLONE ID no.1798756
  misc_feature: Bit score of 363.6 for HMM based on sequences of FIGURE 7.
  misc_feature (102)..(142): Pfam Name: zf-AN1 Pfam Description: AN1-like Zinc finger
  misc_feature (13)..(37): Pfam Name: zf-A20 Pfam Description: A20-like zinc finger
  misc_feature: Functional Homolog Of Ceres SEEDLINE ID no. ME04477 at SEQ ID NO. 742
MAEEHRCQAPEGHRLCVNNCGFFGSSATMNLCSKCYRDLCLKEQEASSIKSALSSSPSSSSTVVESISQVPLLALHEVNRESAVPEIASAAEQRSQQQPNRCMVCRKRVGLTGFRCKCGVTFCGSHRYPENHGCTFDFKKVGREEIARANPLVKAEKLEKI

SEQ ID NO: 764 - DNA, 1074 bp, Populus balsamifera subsp. trichocarpa
  misc_feature: Ceres ANNOT ID no.1451912
  misc_feature: Encodes the peptide sequence at SEQ ID NO 726
atgacaaaccagaatgtggttgtgcctaatgccagaaaaggtgttgatatcaccatcacaatggccctgtccaagtctctgttttcacctgttgtgccgaagccattgccagctgctcctggtgggtatttcacaatatcccggaagatgttcgcaaagaagactgaaactggaggcaaaaccaattcctgggctgattctatgagagattcttcacctacccgtgtcaaatccactacgtctttatcagaaatcgaggagaaaaatacttggattgtaaatcatccttctgctttgaacatgttcgagcaaatagtgaatggctcaaagggaaaacagattgtaatgtttttagattatgatggtacactgtcacccattgttgaagatcctgacagggcattcatgaccaacgagatgagagaagctgttagggacgtcgctagatactttcccactgctatagtgacgggaaggtgtagggataaggtgtacagcttcgtaagattggcagggctttattacgctggtagccatggcatggacatcaagggaccatccaagaattgttgcagaaacaaaaaagattatcaaggtgtactttttcaacctgccagtgattttttacccatgattgatgaggtgtacaatgctttgctggagagaacaaagtatatcccaggggctagagtagaagacaacaaattttgcatatccgtacactttcgttgtgtcgaggaaaagatgtgggctgcattagtagagcaagtaagatcagttctcaatggttatccaaaacttcgattaactcaagggaggaaggttttagagatccgacccaccattaaatgggacaagggcaaagctcttgagttcgtgttggaatcattaggatatgccaattctactgatgttttaccagtttatattggagatgatcgaactgatgaggatgcattcaaggttctaagaaacaggggacaagggcttgggattcttgtttctaaagttcccaaggaaacaaatgcctcgtattctctacaagagccaacagaggcaagttctttaatctaa

SEQ ID NO: 765 - protein, 318 aa, Populus balsamifera subsp. trichocarpa
  misc_feature: Ceres ANNOT ID no.1504999
  misc_feature: Bit score of 560.3 for HMM based on sequences of FIGURE 9.
  misc_feature (68)..(302): Pfam Name: Trehalose_PPase Pfam Description: Trehalose-phosphatase
  misc_feature: Functional Homolog Of Ceres SEEDLINE ID no. ME20095 at SEQ ID NO. 1129
MFAKKTETGGKTNSWADSMRDSSPTRVKSTTSLSEIEEKNTWIVNHPSALNMFEQIVNGSKGKQIVMFLDYDGTLSPIVEDPDRAFMTNEMREAVRDVARYFPTAIVTGRCRDKVYSFVRLAGLYYAGSHGMDIKGPSKNCCRNKKDYQGVLFQPASDFLPMIDEVYNALLERTKYIPGARVEDNKFCISVHFRCVEEKMWAALVEQVRSVLNGYPKLRLTQGRKVLEIRPTIKWDKGKALEFVLESLGYANSTDVLPVYIGDDRTDEDAFKVLRNRGQGLGILVSKVPKETNASYSLQEPTEARDLWSLLYFLDAKK

SEQ ID NO: 766 - DNA, 852 bp, Gossypium hirsutum
  misc_feature: Ceres CLONE ID no.1918424
  misc_feature: Encodes the peptide sequence at SEQ ID NO 767
gttcacattcttccttccaccttttcctttcaagatcgaaagattttttctttttttaaaaatggcggaggagcatagatgccaaacgccggaaggccaccgtctttgcgttaacaactgcggctttttcggaagtccggcgacaatgaatctttgctctaaatgttatagagatttccgtcttaaagaacaacagggagctacttccatcaaatcatctctttcttcctctccttcgttttcatcttcgtcagtcgttgtcgaatccgtttctcaggttccgctgttcaatctgcctgagttcattggagaatcgccagttcctgcagtggaggttgccctggtggctgagcaacggccgcaacagcaacaaccgaatcgatgcatggtttgcaggaaacgggtcgggttgaccgggttcaggtgcaaatgcgagattacattttgcgggtcccataggtatccagagaatcacgggtgtaccttcgatttcaaggaggttgggagagaggagattgcacgcgcaaatccactggtcaaagcagagaagctggagaagatttgagatgaaagtggaaagccattggatccctcgactttcgatgaaataaaaaaaaaaaagcaaatgaaaatgatctctttaagattgcgacacgtgtttagatgtagtccccaccatgaagagaaaccaattaggctggataaaattattttcatcctaataggttttcttaaaatatatataatattttaatttatgtgcctcttttagtctttctcttttgtaaaaaaagacttttttttttttcttttcaaaaaaaaaaaaaaaaaaaaaaaaaaaaaaaaaaaaaa

SEQ ID NO: 767 - protein, 167 aa, Gossypium hirsutum
  misc_feature: Ceres CLONE ID no.1918424
  misc_feature: Bit score of 336.0 for HMM based on sequences of FIGURE 7.
  misc_feature (108)..(148): Pfam Name: zf-AN1 Pfam Description: AN1-like Zinc finger
  misc_feature (13)..(37): Pfam Name: zf-A20 Pfam Description: A20-like zinc finger
  misc_feature: Functional Homolog Of Ceres SEEDLINE ID no. ME04477 at SEQ ID NO. 742
MAEEHRCQTPEGHRLCVNNCGFFGSPATMNLCSKCYRDFRLKEQQGATSIKSSLSSSPSFSSSSVVVESVSQVPLFNLPEFIGESPVPAVEVALVAEQRPQQQQPNRCMVCRKRVGLTGFRCKCEITFCGSHRYPENHGCTFDFKEVGREEIARANPLVKAEKLEKI

SEQ ID NO: 768 - protein, 407 aa, Zea mays
  misc_feature: Public GI ID no. 194693220
  misc_feature (1)..(407): Bit score of 268.3 for hmm based on sequences of FIGURE 11.
  misc_feature (49)..(226): Pfam Name: HSF_DNA-bind Pfam Description: HSF-type DNA-binding
  misc_feature: Functional Homolog Of SEQ ID NO. 364
MGSKKRSPQHPASPAGGEVGAQAAGKATPVTAAPETAPVAVVPKPPDVAPFLTKVYDMVSDPATDAVISWSAGGGSFVIWDSHVFERDLLPRHFKHNHFTSFIRQLNTYGFHKVDPDRWEWANEGFIKGQKHLLKTIKRKKKSSQDVPSDLQSVPVKTAPGTENIEIGKYGGLEKEVETLKRDKALLMQQLVDLRQYQQTSSLEVQSLIQRLRVMEQNQQQMMALLAIVVHNPDFLNQLVQQQCRSNWWNDDGNRKRRFQALEHGPVDDSETSGGGAQIIQYCPPVPETSNQPTPANEAFCSSPVQSVSSHALEMPMDVEMASNNVGTLDSTGNDFTDTSALCEWDDMDIFGGGLEHILQQTEQDFQVDPLTIEDYGYDRPWLEQDCQVEAQQNCKNPQYADVITEA

SEQ ID NO: 769 - protein, 408 aa, Zea mays
  misc_feature: Public GI ID no. 194708220
  misc_feature (1)..(408): Bit score of 262.2 for hmm based on sequences of FIGURE 11.
  misc_feature (49)..(226): Pfam Name: HSF_DNA-bind Pfam Description: HSF-type DNA-binding
  misc_feature: Functional Homolog Of SEQ ID NO. 364
MGFTKRSPQHPASPAGGEVGAQTAGKVTPVPAAPESAPAAVVPRPPDVAPFLTKVYDMVSDPATDAVISWSAAGGSFVIWDSHAFERDLLPRHFKHNHFTSFIRQLNTYGFHKVDPDRWEWANEGFVKGQKHLLKTIKRKKKSSQDVPSDLQSVPVKTAPGTENIEIGKYGGLEKEVETLKRDKALLMQQLVDLRQYQQSSSAEVQNLIQRLRVMEQNQQQMMALLAIVVQNPDFLNQLVQQQRRSNWWNDDGNRKRRFQALEHGPVDDQETSGGGAQIIQYRPPVPETSNQPIPANEAFYSTPAQPASSPALEMPMDVEMASNNVNTFDSTGNDFTDTSALCEWDDMDIFGDELEHILQQPEQDFQVDPPLTVEDYGYDHPRLEQDCQMEAQQNCKNPQYADVITEA

SEQ ID NO: 770 - DNA, 898 bp, Gossypium hirsutum
  misc_feature: Ceres CLONE ID no.1845154
  misc_feature: Encodes the peptide sequence at SEQ ID NO 771
tcgttgtttcctccttcccttctatcctctcatcccctcttccctttaataagaggcttcttttctgataattctttgctttgttcatagtttcccttcaaaattcagagatcttgcagatctgattttcaaaaataaaaaattaaaggcaaatatcaagagatttcgaagaaaaacaagaaaagatggcggaggaacatagatgccaagcgccggaaggtcaccgtctttgtgttaataactgtggtttcttaggaagtccggcgacgatgaatctttgttctaaatgttacagagatttccgtcttaaagaacaacaacaagcttcttcggctaaatcgtctatctctacctctccttcatcttcgtcaactgcagtcgaatctgtttctcaggtacctctcctgactctccctgaagtcaaaggagttccgccggttgtttcggctgtcgcgatctctccggtgacggaacagaaaccacaacagcaacagcaacaacaacaacaaccgactcggtgcacggtttgcaggaaacgggtcgggttgaccggattcaagtgcaagtgcgggattacgttttgcgggtcacacaggtacccggaaaatcatggatgcacgttcgatttcaagaagattgggcgagaggagattgcacgtgccaatcccgtggtcaaagcagagaagatcgtgaggatttgagaagaagaagatggaaagccgatcgatcctttgacttttaatgagtaaaagaaaaagagaaatagaaattgtcaaactcgttaagattgcgacacgtgtttcggtgttggtccccatacctttaaaaattgggcttggataaaaatattttatcttataaaataagtcttctattttaaaaaaaaaaaaaaaaaaaa

SEQ ID NO: 771 - protein, 171 aa, Gossypium hirsutum
  misc_feature: Ceres CLONE ID no.1845154
  misc_feature: Bit score of 368.8 for HMM based on sequences of FIGURE 7.
  misc_feature (112)..(152): Pfam Name: zf-AN1 Pfam Description: AN1-like Zinc finger
  misc_feature (13)..(37): Pfam Name: zf-A20 Pfam Description: A20-like zinc finger
  misc_feature: Functional Homolog Of Ceres SEEDLINE ID no. ME04477 at SEQ ID NO. 742
MAEEHRCQAPEGHRLCVNNCGFLGSPATMNLCSKCYRDFRLKEQQQASSAKSSISTSPSSSSTAVESVSQVPLLTLPEVKGVPPVVSAVAISPVTEQKPQQQQQQQQQPTRCTVCRKRVGLTGFKCKCGITFCGSHRYPENHGCTFDFKKIGREEIARANPVVKAEKIVRI

SEQ ID NO: 772 - DNA, 1104 bp, Populus balsamifera subsp. trichocarpa
  misc_feature: Ceres ANNOT ID no.1504999
  misc_feature: Encodes the peptide sequence at SEQ ID NO 765
atgacaaaccagaatgtggttgtgcctaatgccagaaaaggtgttgatatcaccatcacaatggccctgtccaagtctctgttttcacctgttgtgccgaagccattgccagctgctcctggtgggtatttcacaatatcccggaagatgttcgcaaagaagactgaaactggaggcaaaaccaattcctgggctgattctatgagagattcttcacctacccgtgtcaaatccactacgtctttatcagaaatcgaggagaaaaatacttggattgtaaatcatccttctgctttgaacatgttcgagcaaatagtgaatggctcaaagggaaaacagattgtaatgtttttagattatgatggtacactgtcacccattgttgaagatcctgacagggcattcatgaccaacgagatgagagaagctgttagggacgtcgctagatactttcccactgctatagtgacgggaaggtgtagggataaggtgtacagcttcgtaagattggcagggctttattacgctggtagccatggcatggacatcaagggaccatccaagaattgttgcagaaacaaaaaagattatcaaggtgtactttttcaacctgccagtgattttttacccatgattgatgaggtgtacaatgctttgctggagagaacaaagtatatcccaggggctagagtagaagacaacaaattttgcatatccgtacactttcgttgtgtcgaggaaaagatgtgggctgcattagtagagcaagtaagatcagttctcaatggttatccaaaacttcgattaactcaagggaggaaggttttagagatccgacccaccattaaatgggacaagggcaaagctcttgagttcgtgttggaatcattaggatatgccaattctactgatgttttaccagtttatattggagatgatcgaactgatgaggatgcattcaaggttctaagaaacaggggacaagggcttgggattcttgtttctaaagttcccaaggaaacaaatgcctcgtattctctacaagagccaacagaggcaagagatctgtggtctcttctttatttcctcgacgccaagaaatag

SEQ ID NO: 773 - protein, 476 aa, Populus balsamifera subsp. trichocarpa
  misc_feature: Ceres ANNOT ID no.1456402
  misc_feature: Bit score of 670.5 for HMM based on sequences of FIGURE 9.
  misc_feature (127)..(361): Pfam Name: Trehalose_PPase Pfam Description: Trehalose-phosphatase
  misc_feature: Functional Homolog Of Ceres SEEDLINE ID no. ME20095 at SEQ ID NO. 1129
MRPSRPSCGKMTNQNVVVADTNSGLNLAITVHVTNSSIFTTAAQKPPAAPGGYISISRKKLLKNLEINGGARINAWVDSMRASSPTHIKSTPSVNEDQSSWILHHPSALEMFEQIIDASKGKQIVMFLDYDGTLSPIVDDPDKAFMSKQVMRATVRKLARFFPTAIVSGRCRDKVYNFVRLAELYYAGSHGMDIKGPAKGSKYKKGGDGVVFQAASEFLPMIDEVYEELVEKTKTTPGAKVENNKFCLSVHYRCVDEKKWSGLAQVVKSVLKEYPKLRLTQGRKVLEIRPTIKWDKGKALEFLLESLGFANCTDVFPVYIGDDRTDEDAFKVLRERGQGFGILVSKIPKDTSASYSLQEPTQASYGFLATFGGVETAGLSRAVKGGVKSSGKIETVQIYPPLQEIVIKATAAWHALAQTHLHVLGTSNRKQSPKFFTNDACKRKVLEPTVASFVNIPLLIISKATPARRLRKGGIV

SEQ ID NO: 774 - protein, 408 aa, Zea mays
  misc_feature: Public GI ID no. 194689430
  misc_feature (1)..(408): Bit score of 257.9 for hmm based on sequences of FIGURE 11.
  misc_feature (49)..(226): Pfam Name: HSF_DNA-bind Pfam Description: HSF-type DNA-binding
  misc_feature: Functional Homolog Of SEQ ID NO. 364
MGFTKRSPQHPASPAGGEVGAQTAGKVTPVPAAPESAPVAVVPRPPDVAPFLTKVYDMVSDPATDAVISWSAGGGSFVIWDSHAFERDLLPRHFKHNHFTSFIRQLNTYGFHKVDPDRWEWANEGFVKGQKHLLKTIKRKKKSSQDVPSDLQSVPVKTAPGTENIEIGKYGGLEKEVETLKRDKALLMQQLVDLRQYQQSSSAEVQNLIQRLRVMEQNQQQMMALLAIVVQNPDFLNQLVQQQRRSNWWNDDGNRKRRFQALEHGPVDDQETSGGGAQIIQYRPPVPETSNQPIPANEAFYSTPAQPASSPALEMPMDVEMTSNNVDTFDSTGNDFTDTSALCEWDDMDIFGDELEHILQQPEQDFQVDPPLTVEDYGYDHPRLEQDCQMEAQQNCKNPQYADVITEA

SEQ ID NO: 775 - protein, 531 aa, Vitis vinifera
  misc_feature: Public GI ID no. 157346270
  misc_feature (1)..(531): Bit score of 183.5 for hmm based on sequences of FIGURE 11.
  misc_feature (98)..(265): Pfam Name: HSF_DNA-bind Pfam Description: HSF-type DNA-binding
  misc_feature: Functional Homolog Of SEQ ID NO. 364
MNPRDNPYLDRKESPPPPYQSEAPAAEAVQPKTEPFSVGSQPFPSGSPLLQIRPISSLEPPFSGEPIVTVGVAAEAEAEAEEIGAPQPLDCLQDNPIPPFLSKTFDIVDDVLLDPIVSWGPTGESFVVWDPVEFSRLVLPRNFKHNNFSSFVRQLNTYGFRKIDSDKWEFANEGFMRGKRHLLKNIRRRKSPQSQHTGSYAGPSSEIAMSGLESEVERLRKQKSLLMQEVIELQQQHSGTIHQMEVVNERIQAAEKRQKKMVSFLAKLLQNPEFLARLLPKDDQKDIGVPRMMRKFVKHQKLEPGKSDSSMGGQIVKYRPGSENLITSSLFPPSNPDSCEQFPNDCLQVIAGKLDLGMESVPFGTRKVSSDELAAVAHKLIEAPEQVREETASLGPVGLVFKGKNLVSSQPEGSTNYNLSFIDDSTKEKAFPEFLSPGIDGIIKQADIWSMGFDDSADMTSSCGELWGNVTNYDVPDLGLTGGISDIWDLGSLQAAEGLGIDKWPSDESTFNEPENQADQPKDYTSKNTYP

SEQ ID NO: 776 - DNA, 1892 bp, Triticum aestivum
  misc_feature: Ceres Clone ID no. 925997
  misc_feature: Encodes the peptide sequence at SEQ ID NO. 777
tttgaggccacgcgcccggcgcgcgatctagaaccttccacagccttcccgacgcctcccgacgcgcgcgcactgtacggacgggtatttagcactgcggccgccactccaccccgccgcccgacgaaattcacccaccgtctccctcatttctttacccacccgcccaccatttctttaccacacgacaaagatctatcccgccgccttcgattccacccgagatatcccgcgattccagccgagcttcagcgggagcagagttggcgggggtcatggaggcggcggtggcggggggcgttgtgaaggaggaggagctgctgctgcacgaggagcagccgccggcggggccgcagcagcaggacggggcgctgccgcggccgatggaggggctgcacgaggccgggccgccgccgttcctcaccaagacgtacgacctggtggaggacccggccacggaccaggtcgtgtcatggggccgcgccggcaacaccttcgtcgtctgggacccgcacgtcttcgccgaggcactgctcccgcgcctcttcaagcactccaacttctccagcttcgtccgccagctcaacacctatggattcagaaaggttgatcctgacagatgggagtttgcaaatgaaggtttccttaggggtcagaggcatcttctcaagatgatcaagagaaggaagccgccatccaacgcgccctcatcgcagcagcaggccctcacatcttgcctggaggttggcgagtttggatttgaggaagagattgacaggctcaagcgcgacaagaacctcttgatcacagaggtagtgaagctaaggcaggagcagcaagctactaaggataacgtgcaagccatggaaggcaggctacgagctgctgaacagagacaggcccagatgatggggttcttggcaagagcaatgcgtaacccacacttcttccaacaattagtccagaagcaagataagaggaaggagcttgaggatgccatctcgaagaaaagaaggcggcctatagacaatgctccattttatggtcccgcggcgacaacaagtcagagcgagcaacttgattcacagttcctgtttgattctggtgtcctcagtgaacctggaatgaatgggatggagaatttagcgcagaacattcaggagcttgggcagggcaaaacagacgaggagaagaaggatgaagctaatgggcagttggatatcaacaacgatttctgggcagagctattttctgatgattttggagacggagacgggtctgggctgtcagagttggagggaaggagacctgaagatatcgacgaactggcacagcagttggggtatctgagttctactagcccgcagtagagttttgttcacagtggttcacttcaaccaacaaacattgcttcttcagtactactattgcagatcatcttgaacaacctgatttagttgattggtggcaacatgactggctatctgaggtgttccataccggagattggaccgtgttgatggcacctctgggtagagagtagaagctgaagactaattgctgcgtcgcttgatggagacccatgacgtgtattgaatgggtacctaaactcgcaactctgaagaagatggtccagatcgtcgacattcggttggtcttgagctggtgttcagcagcagtagctgtggaagtgtgttactgtatatactcgttgggtgaagttttgttgtggaagtctggtctgtagtcagccgttggcatctgggtgtgggtttacccatttctcctgctgctgtccatttgccaatttaccttacttttagggcctgtgtcctgtgtgatgattggtagtgtatgctggaacctctgttatattgagataataaatgttc

SEQ ID NO: 777 - protein, 364 aa, Triticum aestivum
  misc_feature: Ceres Clone ID no. 925997
  misc_feature (1)..(364): Bit score of 728.3 for hmm based on sequences of FIGURE 11.
  misc_feature (46)..(215): Pfam Name: HSF_DNA-bind Pfam Description: HSF-type DNA-binding
  misc_feature: Functional Homolog Of SEQ ID NO. 364
MEAAVAGGVVKEEELLLHEEQPPAGPQQQDGALPRPMEGLHEAGPPPFLTKTYDLVEDPATDQVVSWGRAGNTFVVWDPHVFAEALLPRLFKHSNFSSFVRQLNTYGFRKVDPDRWEFANEGFLRGQRHLLKMIKRRKPPSNAPSSQQQALTSCLEVGEFGFEEEIDRLKRDKNLLITEVVKLRQEQQATKDNVQAMEGRLRAAEQRQAQMMGFLARAMRNPHFFQQLVQKQDKRKELEDAISKKRRRPIDNAPFYGPAATTSQSEQLDSQFLFDSGVLSEPGMNGMENLAQNIQELGQGKTDEEKKDEANGQLDINNDFWAELFSDDFGDGDGSGLSELEGRRPEDIDELAQQLGYLSSTSPQ

SEQ ID NO: 778 - DNA, 1963 bp, Panicum virgatum
  misc_feature: Ceres Clone ID no. 1862704
  misc_feature: Encodes the peptide sequence at SEQ ID NO. 779
ctcgccacccaaatattccgcggagaacccacccactcgctgcctgcaatcgcctccccatccccacccccccgcgcgggcctcctaaccctagtcctcgtcccgtccccccatggcggcgtgaacggccgccgtacggatcgcgcgggatatgcagggcggtgtcgcggctgctgccgctgctgctgcggcggccgcggcgacggtgaccacggcggtggcgcctccagtggccccggcccctgcggccgcgaccgctcacgcggcggtgggtaacggcggggcggccaccgcgccgccgccgcccttcctcatgaagacctacgagatggtcgacgacccggccacggacgacgtcgtgtcctggggccccgggaacaacagcttcatcgtctggaacacgcccgagttcgccagggacctcctgcccaagtacttcaagcacagcaacttctcctccttcgtcaggcagctcaacacatatgggtttagaaaggttgatccagacagatgggaatttgcaaatgagggttttctgagaggacaaaaacatctattgaagactatcaacagaaggaaaccatcgttgcaggggaacagccagccgcagcagccccaattgcagaacgctcctttgccagcctgtgttgaggtcggtaaatttgggctggaggaagagatagaacggctgaaaagggataagaatgttcttatgcaagagcttgtcaggctgagacagcaacagcagacaactgaccatcagctgcagactttggggaagcgtcttcaagggatggagtcacggcagcaacagatgatgtctttcctggccaaagcaatgcaaagtcctggtttcctagcacagttcgtacagcaaaatgagaacagcaggaggagaatagtagccgtgaacaagaagaggaggctgcccaagcaagatgacggcctagactctgaaagtgcttctgcctcattggacggtcaaattgtcaagtatcagcctatgatcaacgaagctgccaaagcaatgctgaggaagatcctaaagctagatgtttcacatagatttgaatctgtgggcaattcagataattttctactggagaattatctgccagccgctcaaggttttgacagctcttcgtcgaccagaaattctggagtaacccttgcagaggttccagctaactcaggtttgccgtatgtggctgcgagctctgggctttcagctatctgttcgtcttcagtggctcctgaaatccagtgtccagttgttttggacaacagctcatccaaccaagttcccaacatgagtgttgtgcctcctgtttcaaagcctatagcaccagggagtgatatcactattccggaattcccagatctggctgacatagtatctgatgactctgatattcctggaggaccctttgggatgcctggacctgagtttcccctggccgaagagggtgatgacagtgtccccatcgagactgatgagattttgtacaatgatgagactcagaagctgccagcaattgtcgattccttctgggagcagttcctggttggcagccctctatctgttgataacgatgaagttgattcaggtgtactagatacaagggagacactaccggagaatggatggaaaaaagtggagcacgtggctaaccttacggaacagatgggccttctatcaccaaatcacagggggtgagatgtattatcctaaggtaggctggtaataagctttggaagcgtcgcctgccctttttgttaatgtttaagattgtccttattgctgaaatgatatgctgatatatcaaccactcaacctatatgcggggggattcaatgttccacccatgaatgatcttggtacgctccaggaattcacctgcttgtatctaggtttggcaggcttgagaacagaacaatggtaacttgtcaaatctgcatgatc

SEQ ID NO: 779 - protein, 521 aa, Panicum virgatum
  misc_feature: Ceres Clone ID no. 1862704
  misc_feature (1)..(521): Bit score of 557.6 for hmm based on sequences of FIGURE 11.
  misc_feature (51)..(226): Pfam Name: HSF_DNA-bind Pfam Description: HSF-type DNA-binding
  misc_feature: Functional Homolog Of SEQ ID NO. 364
MQGGVAAAAAAAAAAAATVTTAVAPPVAPAPAAATAHAAVGNGGAATAPPPPFLMKTYEMVDDPATDDVVSWGPGNNSFIVWNTPEFARDLLPKYFKHSNFSSFVRQLNTYGFRKVDPDRWEFANEGFLRGQKHLLKTINRRKPSLQGNSQPQQPQLQNAPLPACVEVGKFGLEEEIERLKRDKNVLMQELVRLRQQQQTTDHQLQTLGKRLQGMESRQQQMMSFLAKAMQSPGFLAQFVQQNENSRRRIVAVNKKRRLPKQDDGLDSESASASLDGQIVKYQPMINEAAKAMLRKILKLDVSHRFESVGNSDNFLLENYLPAAQGFDSSSSTRNSGVTLAEVPANSGLPYVAASSGLSAICSSSVAPEIQCPVVLDNSSSNQVPNMSVVPPVSKPIAPGSDITIPEFPDLADIVSDDSDIPGGPFGMPGPEFPLAEEGDDSVPIETDEILYNDETQKLPAIVDSFWEQFLVGSPLSVDNDEVDSGVLDTRETLPENGWKKVEHVANLTEQMGLLSPNHRG

SEQ ID NO: 780 - DNA, 1749 bp, Populus balsamifera subsp. trichocarpa
  misc_feature: Ceres ANNOT ID no.1456402
  misc_feature: Encodes the peptide sequence at SEQ ID NO 773
atggtgtggtgttggtgttttcatgagagggagggatcggaggtgggctgtaaattgtttatgcatccaaagccaaaggtgcaggtggatgacgagttggtggggctggcatctagtatttacacgtggcgggaatccaccatagtcaagtcaaccaaagaatgtcttccacgtacacaaactactagctggcaaggaagttatggtccttatggaagacggctaggggccaaagccgcatgtgggtccacttcaggatttcgggtgctgggccagttctgtgggtcccgcagtttagagtttactaggagagggtgcatgaggccctcgcgtccgtcttgtggaaagatgacaaaccaaaatgtggtagtggctgatacaaactctggactcaacttggcaatcacagtgcatgtaacaaactcctctatcttcacaacggcggcccagaaacctccagcggcaccaggtggttacatatccatttctagaaagaaactcttaaagaatctggaaatcaatggaggagcaagaattaatgcttgggttgattccatgagagcctcatctcctactcatatcaagtccacgccttctgttaatgaagaccaaagctcatggattcttcaccacccatcagcactggagatgtttgagcagataattgatgcctctaaaggaaagcaaattgttatgttcttggactatgatggcacactttctcctattgttgatgacccagataaagctttcatgtccaagcaggtgatgagagcaacagtgagaaagcttgcaagatttttccctactgcaatagtgagtgggaggtgcagagacaaggtgtataactttgtacggttagcagaactgtactatgctggaagccatggcatggacattaaaggaccagcaaaaggctccaaatacaagaaaggcggtgatggtgttgtctttcaggctgccagtgaatttcttcccatgatagatgaggtttacgaagaattggtagagaaaactaaaacaactccaggggccaaggtggagaacaacaaattctgcctctctgtgcactatcgctgcgttgatgagaaaaaatggagtggactggcacaagtagttaagtcagtgttgaaggagtacccaaagcttcgacttactcaaggaagaaaggttttagaaatccgccctaccattaaatgggacaaaggaaaggctcttgaatttttgttagagtcacttggattcgccaattgcactgatgtttttcctgtttacattggagatgatagaacagacgaagatgcatttaaggtactaagagagagaggacaaggttttggtatcttggtctctaaaatcccaaaggacactagtgcatcttattccctacaggaacccacccaggcaagttatggatttcttgcgacgtttggtggagtggaaacggctggcctttcaagggcggtcaagggtggtgtaaagagtagtgggaagattgagacagtacagatatacccaccccttcaagaaattgtaattaaagccactgcagcttggcatgctttagctcaaacacacttgcatgtgcttgggacctcaaatcgcaaacaaagccccaaatttttcacaaacgatgcttgtaagagaaaggtccttgagcccacggttgccagctttgtgaatattcctttgctaataatttcgaaggctacccccgctagaaggttgaggaagggaggtatcgtgtga

SEQ ID NO: 781 - protein, 352 aa, Populus balsamifera subsp. trichocarpa
  misc_feature: Ceres ANNOT ID no.1496359
  misc_feature: Bit score of 651.8 for HMM based on sequences of FIGURE 9.
  misc_feature (97)..(329): Pfam Name: Trehalose_PPase Pfam Description: Trehalose-phosphatase
  misc_feature: Functional Homolog Of Ceres SEEDLINE ID no. ME20095 at SEQ ID NO. 1129
MVLPKSLFSPVVPKPLPAAPGGYFTITRKRFSKKTETGGKISSWVDSMRDSSPTRVKSTTSLSETEEKNSWIVNHPSALNMFEQIVKGSKGKQIVMFLDYDGTLSPIVEDPDRAFMTNEMREAVRDVARYFPTAIVTGRCRKKVYSFVRLAGLYYAGSHGMDIKGPSKNNCKYEKGGVLFQPASEFLPMIDEVYNVLLERTKSIPGAKVENNKFCVSVHFRCVEEKMWAILVEQVRSVLNDYPKLRLTQGRKVLEIRPTIKWDKGKALEFLLESLGYANSTDVFPVYIGDDRTDEDAFKVLRNRGQGLGILVSKVPKETNASYSLQEPKEVKDFLRRLVEWKRSSLQGQRRA

SEQ ID NO: 782 - DNA, 877 bp, Gossypium hirsutum
  misc_feature: Ceres Clone ID no. 100059286
  misc_feature: Encodes the peptide sequence at SEQ ID NO. 783
tcgaaatgaagtgaagtgaaaacgaagtctcaaatggaaggagttgtagtaaaagaagaggaaactcaaatgacgtttgcaacagctgttgggactactgctgggttgtcttcatcttcatcgtcatcaaatgttactcctcagccgaaggaagggcttaacgaggttggtccgccgccgttcttgactaaaacttttgatatggtggaagacccttcgacggattcggtggtttcatggagtgaagctcgtaatagtttcattgtttgggattctcataaattttcaaccacgttgcttcctaggcacttcaagcacaacaatttctccagtttcattcgtcagctcaatacatatggttttagaaaagttgatccagatcgatgggaatttgccaatgaagggtttttaggagggcaaaagcagctacttaaaacgattaagaggagaaggaacatagtgcaaagctcacagcatcaagctggaggaggaggagcttgtgttgagttaggacaatttggattagatgaagaactggagagattaaagagggatcgaagtgttttactagctgaaatcgtgagattaagacaacaacagcagcattcaagggaccagattgttgcaatggaggataggttacagagcacagagaagaaacagcaacagataatgtcgttccttgctaaggcacttcgaaacccgactttcatacagcaacttgctcagaacagacaggctaaaggcgtcgaaatcggacgaaaacggaggctcacggcgagccccagtgtggagaatttacaacaagcagcagtccctgtggtggttgataatgatcaagttgaggaacaagaaggattggcaactattgagactg

SEQ ID NO: 783 - protein, 281 aa, Gossypium hirsutum
  misc_feature: Ceres Clone ID no. 100059286
  misc_feature (1)..(281): Bit score of 471.8 for hmm based on sequences of FIGURE 11.
  misc_feature (48)..(217): Pfam Name: HSF_DNA-bind Pfam Description: HSF-type DNA-binding
  misc_feature: Functional Homolog Of SEQ ID NO. 364
MEGVVVKEEETQMTFATAVGTTAGLSSSSSSSNVTPQPKEGLNEVGPPPFLTKTFDMVEDPSTDSVVSWSEARNSFIVWDSHKFSTTLLPRHFKHNNFSSFIRQLNTYGFRKVDPDRWEFANEGFLGGQKQLLKTIKRRRNIVQSSQHQAGGGGACVELGQFGLDEELERLKRDRSVLLAEIVRLRQQQQHSRDQIVAMEDRLQSTEKKQQQIMSFLAKALRNPTFIQQLAQNRQAKGVEIGRKRRLTASPSVENLQQAAVPVVVDNDQVEEQEGLATIET

SEQ ID NO: 784 - DNA, 2323 bp, Zea mays
  misc_feature: Ceres Clone ID no. 1577511
  misc_feature: Encodes the peptide sequence at SEQ ID NO. 785
gaggaatccattcccaatttgcgttcccactcccaccaccgcttcttcccgtatcccttgtcctccctaatttcctctcacaaaaagcgggtgcggcgtcctgccactcacctcggtctcggggggcgccgtgcggcgggcgcccgtgctgctggtttcgctccaggggagaaggggcagagggagtagagcaggttaggtccgtttgcgttttcttttgcgggtttgtaggtcaaaagctcggcgagcactttccgctccacctcctcacgctcggaatcaaatcgatgccccccctgatttggttcctggtatcggtgcatgagcttgctccaagagatctcccttttggttcggcgtcaggggttctgtgaggtcacgcggcttcttcctcttggcgctcctcacatgtccgggcgcttcgatctctgcccactgcgcgagtgattctgctgctgcagcagctgttaggtgcgcgcggtccgttatggggtgaaccgaagcgttcctcgcagggctgtgggtttattacgccgcctgtttgcttccccgctccatgtccttgtgcccatgcttctttgcttttgtcacgcctgaaccgtgtcttcttgtagtatctgaggcttggcagttggcaagtacaaactagcaacttgcttaggtataaagtataaaccagtgtctggtgcagagcccaaaggggtcacgaatcgttgatgcatagatctgcttctggctgagataaggctctaagttcgctctgttgatggggctaccatgagccacgggaacgggatgttgaattctgtcaaggtggagaggtggccagcagcagtcgctgcaaatggccagcctaggccgatggatgtgctccacgacggcagctcgccgccgttccttaccaagacgtatgacatggttgatgacccaaccacgaacgccgttgtgtcatggagtgccgccaacaatagctttgtagtttgggatcctcatatctttgggacggtgctgctgccaaggtacttcaagcacaacaacttctccagctttgttcggcagctcaatacttatggcttcagaaaggtggatcctgacagatgggaatttgctaatgaggagtttctgagaggtcagaggcacctcctcaaaaacattaggcgtcggaaacctccacactcatctccaaatcaacaatctcttggctcttacctcgaggtaggacactttggatatgaagaagagattgatcagctgaagagggataaacagctcttgatggctgaggtagtgaagctgaggcaggagcaccaaaatactagatcagatctacaggccatggaagagaaattacaagataccgagcagaagcagcagcagatgatggcattcatggcacgcgtcatgcagaaccctgatttcatgcgtcagctgatctcccagcgggagatgaggaaggagctcgaggatgccatctcgaagaagagaaggcgccgcattgaccagggacatgaagctggtagcatgggcactggttctagcctggagcaagggccacagggagtgtttgaaccgcaggagccggtggaatcactcgccaacggtgtgccatctgatctggagagttcgtctgttgaggcgaagggattggaggttcgacagggtgtttcttcaggtggttctgagcatctgaatggcaggccaagcggagagttaaatgatgatttctgggaggaccttctgcacgaggggggacttggtgcagatgcaggcaatgctgttggtcaggatgatatgaacatggacatggacccagatgttagcctgcctcaactgaaacaacatggacccagacattagccgctcttgtgctatcacaatggctgtgactctgtgagtatctttacagttatgctcgttatacccctgtggtgtacctgtttcgatcgtcttcgaccaaatgtcacgtcgactgcagtctccagttgttaatacagtctgttcagcacgctgatttaagtatttgggtcaagatgttcatataatcctgtggtatccagagatattatagtttgttttcgtaactgtttgcgcagagaccatgctatgttgcctgcaggctatcagtgtatttgttctaacagatcgcaacgctggtacaacgcagtgacctgccagactgggccactatgagattgtagggaaagaccagatagcttgtgtatgtaaaagctgatccatagtagcctatcatgtgcaacgctattgccctttgggatttggcatttcactgtatataacatatcatcgccgtattgccgcatcc

SEQ ID NO: 785 - protein, 359 aa, Zea mays; identical to SEQ ID NO: 348
  misc_feature: Ceres Clone ID no. 1577511
  misc_feature (1)..(359): Bit score of 414.2 for hmm based on sequences of FIGURE 11.
  misc_feature (38)..(205): Pfam Name: HSF_DNA-bind Pfam Description: HSF-type DNA-binding
  misc_feature: Functional Homolog Of SEQ ID NO. 364

SEQ ID NO: 786 - DNA, 660 bp, Brassica napus; identical to SEQ ID NO: 722
  misc_feature: Ceres Clone ID no. 1075098
  misc_feature: Encodes the peptide sequence at SEQ ID NO. 787

SEQ ID NO: 787 - protein, 125 aa, Brassica napus
  misc_feature: Ceres Clone ID no. 1075098
  misc_feature (1)..(125): Bit score of 198.4 for hmm based on sequences of FIGURE 6.
  misc_feature: Functional Homolog Of SEQ ID NO. 711
MPIGFRNQVMRSFSWIIIPLLLLLFCLIGSSQAADEKSSGDVCNTVSDPGGCPINCFRADPVCGADGVTYWCGCPDAACHGARVVKTGACDAGNAGSASVPGQALLLIHIVWLFLLGLSLLVGAF

SEQ ID NO: 788 - DNA, 1619 bp, Zea mays
  misc_feature: Ceres Clone ID no. 229513
  misc_feature: Encodes the peptide sequence at SEQ ID NO. 789
gccaaatcgaaggagattgaacgaagcagcccagccaaattcccctcgccgccccgtcccttctcgacatttcttgtcccgtcgtcgcctcaatctcgaagcctctccggcggagccgcctcatcatgttccgaaggcctccaaccaaacatcctctagggtttccgcatcgtccgtcgcgatgggcttcacgaagcggtcgccccagcatcccgcctccccagccggcggcgaggtcggcgcccagacggcagggaaggtcacaccagtgccggcggcgccggagtcggcgcccgcggcggtggtgccgaggcctccggacgtggcgcccttcctgaccaaggtctacgacatggtctccgacccggccaccgacgcggtcatctcctggagcgccgccggcggcagtttcgtgatctgggactcgcacgctttcgagcgcgacctgctgccgcggcacttcaagcacaatcacttcaccagcttcatacgccagctcaacacctacggatttcataaagttgatccagatagatgggaatgggccaatgaaggctttgttaagggccaaaaacatcttttgaagaccatcaagagaaagaagaaatcctctcaggatgtacctagtgatctgcagtcggtgcctgtcaaaactgcacctggcactgagaatatcgagataggaaaatatggaggccttgaaaaggaggttgagacacttaagagggacaaggcccttctaatgcagcagcttgtagatctacggcagtaccagcaatcatctagcgctgaagtgcagaatttaattcaacgcctccgtgtgatggagcagaaccagcagcagatgatggcacttttggcaattgttgtccagaatccagacttcctgaaccagctcgtgcagcagcagcgcaggagtaactggtggaatgatgatggtaacaggaaaagaaggttccaagctctggaacatggtcctgtagatgaccaagagacttctggtggaggcgcacaaattattcaatatcgtcctcctgttcctgaaacttccaatcagccaataccagcaaatgaagctttctattcaacccctgcacaaccagcttcaagccctgcacttgagatgcccatggatgtagagatgacttcaaacaatgttaatacctttgattcaactggcaatgattttactgacacctctgctctatgtgaatggtatgacatggatatatttggtgatgaacttgagcacattcttcaacagccagagcaggactttcaagtggaccctcctttaacagttgaggattatggttatgatcatccacggttagagcaggactatcagatggaagcacaacagaattgcaaaaatcctcaatatgttgcctgtgtcttgaagcaaagggaaagccatgcatctgatgtccattagtactgatcagtttgagctgatgtcataactgaagcatgagcggtggtcccccagaatgttgtccagtaacattagtggatagagatttgtgatgaacagaatcttgagactggcaggttagccaccattgggaacctgaagaccgtcgggattgctcagaattcagtatactaatactaatact

SEQ ID NO: 789 - protein, 417 aa, Zea mays
  misc_feature: Ceres Clone ID no. 229513
  misc_feature (1)..(417): Bit score of 260.0 for hmm based on sequences of FIGURE 11.
  misc_feature (49)..(226): Pfam Name: HSF_DNA-bind Pfam Description: HSF-type DNA-binding
  misc_feature: Functional Homolog Of SEQ ID NO. 364
MGFTKRSPQHPASPAGGEVGAQTAGKVTPVPAAPESAPAAVVPRPPDVAPFLTKVYDMVSDPATDAVISWSAAGGSFVIWDSHAFERDLLPRHFKHNHFTSFIRQLNTYGFHKVDPDRWEWANEGFVKGQKHLLKTIKRKKKSSQDVPSDLQSVPVKTAPGTENIEIGKYGGLEKEVETLKRDKALLMQQLVDLRQYQQSSSAEVQNLIQRLRVMEQNQQQMMALLAIVVQNPDFLNQLVQQQRRSNWWNDDGNRKRRFQALEHGPVDDQETSGGGAQIIQYRPPVPETSNQPIPANEAFYSTPAQPASSPALEMPMDVEMTSNNVNTFDSTGNDFTDTSALCEWYDMDIFGDELEHILQQPEQDFQVDPPLTVEDYGYDHPRLEQDYQMEAQQNCKNPQYVACVLKQRESHASDVH

SEQ ID NO: 790 - DNA, 1077 bp, Sorghum bicolor
  misc_feature: Ceres Annot ID no. 8666698
  misc_feature: Encodes the peptide sequence at SEQ ID NO. 791
atggcgcggagcgtggccgtggcggcagtgaagctggagccgaagccggagccgtgggcggcgggcgcagaggaggcgtcgtcagtggtgccgcggtcgatggaggggccgccgctccctgcgccgttcgtgtcgaagacgtacgagatggtggcggacgcggccacggacgccgtggtgtcgtgggcgcccggcggcgcggggaacagcttcgtggtgtgggacccgcgggcgctcgccgccggcatcctcccgcgcttcttcaagcacgccaacttcgcgtccttcatcaggcagctcaacatctacggattcaggaaggtgaatccggatcgttgggagtttgcaaacgaatccttcttagcaggccagaagcatttgctgaaaaatatcaagaggaggcgtgcttccaagcctcagatggaagcaaagccaagaaactgtgctggtgcttgtctcggttcgccgaaggatcccagcgaggtcgagagtttgaaacgagaccgcgcagcgctcagggccgaagtcatcacgctaaggcagcagtacaacatctgcaaatcccaactcgtcgccttggaggagaggatcctgaacaacgagaggaaccagcagagggccatcgccttcttcgcaaaggtgctcagcaacccaggtttcgtgcagcaggtcctgctcaactatgccaaggagaaagaactacgtggcgcttccaaaagacagcggctgatggaaaacgaagaacatcggcacggcgatttgccactgaggagtggcaccgaagctgcgtttgcgacagtggcggctggcgttggcgtctctgcggggagcagccatggtggcacagccgcgaaacaggagcctgggcctgagttgaatggtcaggagatggacagtatttggtatgatgtgtgggacgagctggacgcgataccaggcgctgaaatggaccggcgagaagcagacaagggcgtggctggcttcgacgtcgaggatttcagtggacggccttgcggttgggatgatgactgctcgtatctcgcggagccgatgcagtttgtggagcactatgactag

SEQ ID NO: 791 - protein, 358 aa, Sorghum bicolor
  misc_feature: Ceres Annot ID no. 8666698
  misc_feature (1)..(358): Bit score of 194.4 for hmm based on sequences of FIGURE 11.
  misc_feature (40)..(210): Pfam Name: HSF_DNA-bind Pfam Description: HSF-type DNA-binding
  misc_feature: Functional Homolog Of SEQ ID NO. 364
MARSVAVAAVKLEPKPEPWAAGAEEASSVVPRSMEGPPLPAPFVSKTYEMVADAATDAVVSWAPGGAGNSFVVWDPRALAAGILPRFFKHANFASFIRQLNIYGFRKVNPDRWEFANESFLAGQKHLLKNIKRRRASKPQMEAKPRNCAGACLGSPKDPSEVESLKRDRAALRAEVITLRQQYNICKSQLVALEERILNNERNQQRAIAFFAKVLSNPGFVQQVLLNYAKEKELRGASKRQRLMENEEHRHGDLPLRSGTEAAFATVAAGVGVSAGSSHGGTAAKQEPGPELNGQEMDSIWYDVWDELDAIPGAEMDRREADKGVAGFDVEDFSGRPCGWDDDCSYLAEPMQFVEHYD

SEQ ID NO: 792 - DNA, 1179 bp, Sorghum bicolor
  misc_feature: Ceres Annot ID no. 8742950
  misc_feature: Encodes the peptide sequence at SEQ ID NO. 793
atggagcgcccagccgtgacggttaagcaggaggaggacgacgacgatgtggtagtggtgttagacgccgacggcgacgctgctggcgggcactggccgggagccgccggcgcggcgccggcgccggcgccggagccttggcagacgccggcggggtccgcggttccgccgttcctggcgaagacgttcgagcttgtggaggacccggcgacggacggcgtgatctcgtggggcgccgcgcggaacagcttcgtggtctgggatccacacgccttctcggcggggcaccttccccgccgcttcaagcacggcaacttctccaccttcctccggcagctcaacacctacgtccgtaatcacatctcaattcttatcggattccgcaaggtgagccctgacaggtgggagttcgcgcacgccgaattcctcgcggggcagcggcccctcctcgtgaacatccagcggcgccgcccgggatccacagcgtctactccgtcttcggcaggggccggcggcggcggagaccgtgataacagcgagctcaagaggctgcggcgggaccgggaggcgctggcgcgggagctgacgcggctgcggcgcgagcaggaggaggcccgcgcgcagctgctggacatggagcggcgcgtgcggggcacggagcggcggcaggagcagtgcacggcctccctggcgcgcgccgtcaggagcccggccttcctggacggcctgctggcgcgccgcggccaaggcggccgcggcggcgcgcacgtagaggccgccggcaggaagcggcggctgctcgacgctgccgcggccgcgaccgcgccggacgcagcggacgtcctcgccttcgaggagctggcgctggcagcgggcgccgaggtcgaggcggcggcgcagatttctgacgccggtaacgccacggacatgatgtggtacgagctgctcggggaggagcaggtggagatcgacgccgaggtggacgagctcgtcgcggccgcggctgccactgaggcggcggcggagccatgggcggagatggacgagaaagaggttgaggagctcgtcgcggctgcggctacagctgccactgaggcggagccgtgggcggagatggacgacgaagaggttgaggagcttgtacagcagatagactgcattggctcgacgggcccctga

SEQ ID NO: 793 - protein, 392 aa, Sorghum bicolor
  misc_feature: Ceres Annot ID no. 8742950
  misc_feature (1)..(392): Bit score of 151.2 for hmm based on sequences of FIGURE 11.
  misc_feature (56)..(230): Pfam Name: HSF_DNA-bind Pfam Description: HSF-type DNA-binding
  misc_feature: Functional Homolog Of SEQ ID NO. 364
MERPAVTVKQEEDDDDVVVVLDADGDAAGGHWPGAAGAAPAPAPEPWQTPAGSAVPPFLAKTFELVEDPATDGVISWGAARNSFVVWDPHAFSAGHLPRRFKHGNFSTFLRQLNTYVRNHISILIGFRKVSPDRWEFAHAEFLAGQRPLLVNIQRRRPGSTASTPSSAGAGGGGDRDNSELKRLRRDREALARELTRLRREQEEARAQLLDMERRVRGTERRQEQCTASLARAVRSPAFLDGLLARRGQGGRGGAHVEAAGRKRRLLDAAAAATAPDAADVLAFEELALAAGAEVEAAAQISDAGNATDMMWYELLGEEQVEIDAEVDELVAAAAATEAAAEPWAEMDEKEVEELVAAAATAATEAEPWAEMDDEEVEELVQQIDCIGSTGP

SEQ ID NO: 794 - DNA, 457 bp, Brassica napus
  misc_feature: Ceres Clone ID no. 1034279
  misc_feature: Encodes the peptide sequence at SEQ ID NO. 795
aaagagaaaggaaaaaaaaaatcaaagatctaaacaatagaagaatgatgaaraagcaagtgacaatagtggcggctcttctgattctggtggctttatcttccaatttggatatggttgctgaggctcagttaggccctggagactgctacgacggttgctccaccgcctgcgtccagcgcgactcgagaaagacgtcccgatgcgatcgcaagtgctctattcggtgtggcccaratgctaaaaaggcaggagagactggtgcttaaactttgatatttactaagatccatattttggatttaataatgttgtaatcttcgtttcaaaattttatctctgcaaaacatattacgtattgtttatgttgttattgtagtcaataaccaataattgctgctccgatgttccatttaactactagtattaccatatgtattaactttgaaatgtaatg

SEQ ID NO: 795 - protein, 74 aa, Brassica napus
  misc_feature: Ceres Clone ID no. 1034279
  misc_feature (1)..(74): Bit score of 189.2 for hmm based on sequences of FIGURE 3.
  misc_feature: Functional Homolog Of SEQ ID NO. 568
  misc_feature (3)..(3): Xaa is any aa, unknown, or other
  misc_feature (65)..(65): Xaa is any aa, unknown, or other
MMXKQVTIVAALLILVALSSNLDMVAEAQLGPGDCYDGCSTACVQRDSRKTSRCDRKCSIRCGPXAKKAGETGA

SEQ ID NO: 796 - protein, 137 aa, Gossypium barbadense
  misc_feature: Public GI ID no. 38016527
  misc_feature (1)..(137): Bit score of 230.6 for hmm based on sequences of FIGURE 7.
  misc_feature (10)..(34): Pfam Name: zf-A20 Pfam Description: A20-like zinc finger
  misc_feature (103)..(131): Pfam Name: zf-AN1 Pfam Description: AN1-like Zinc finger
  misc_feature: Functional Homolog Of SEQ ID NO. 742
MAEEHRCQAPQLCANNCGFFGSPTTQNLCSECYRGLQLKEQQSSSAKQAFNHTLVPSSSSLPSSSSARSSFSASLPAKEEPSAGTKETKVVEEEEVQVTPNRCLSCKKRVGLTGFKCRCGMVFCGIHRYPGTTCLCF

SEQ ID NO: 797 - protein, 131 aa, Brassica napus
  misc_feature: Ceres Clone ID no. 1084216
  misc_feature (1)..(137): Bit score of 212.2 for hmm based on sequences of FIGURE 7.
  misc_feature (99)..(131): Pfam Name: zf-AN1 Pfam Description: AN1-like Zinc finger
  misc_feature (25)..(49): Pfam Name: zf-A20 Pfam Description: A20-like Zinc finger
  misc_feature: Functional Homolog Of SEQ ID NO. 742
  misc_feature (128)..(128): Xaa is any aa, unknown, or other
MAQRTEKEETEFKVVLETLPTTTTPTLCSNNCGVTASPSTNNMCQKCFNASVAGIDPNPIVKRSARSVSLRSTPARAVIRPRETDPVKRDHHQQTVNRCSGCRKKVGLTGFRCRCGDLFCSEHRYSDXHEC

SEQ ID NO: 798 - protein, 173 aa, Camellia sinensis
  misc_feature: Public GI ID no. 113196593
  misc_feature (1)..(173): Bit score of 366.3 for hmm based on sequences of FIGURE 7.
  misc_feature (114)..(154): Pfam Name: zf-AN1 Pfam Description: AN1-like Zinc finger
  misc_feature (15)..(39): Pfam Name: zf-A20 Pfam Description: A20-like zinc finger
  misc_feature: Functional Homolog Of SEQ ID NO. 742
MEQNETGCQVPPDAPMLCVNNCGFFGSAATMNPCSKCHKDLMLKQQQTELAASSIGSIANGGSGSPGKEPDSAITTVHVDAGSSDSMIVSMQASHESLLNENNVIVKEVPPNRCSACRKRVGLTGFNCRCGNLFCAVHRYSDKHDCPFDYRSAAQDAIAKANPVVKAEKLDKL

SEQ ID NO: 799 - protein, 224 aa, Oryza sativa subsp. japonica
  misc_feature: Public GI ID no. 75133829
  misc_feature (1)..(224): Bit score of 391.5 for hmm based on sequences of FIGURE 7.
  misc_feature (165)..(205): Pfam Name: zf-AN1 Pfam Description: AN1-like Zinc finger
  misc_feature (18)..(42): Pfam Name: zf-A20 Pfam Description: A20-like zinc finger
  misc_feature: Functional Homolog Of SEQ ID NO. 742
MEEQQAAAAGGGGGGGGASMCANGCGFFGSEATKKLCSKCYRDQLKAAPSSPPAAPDLVANEEEEASTAAAAAADEQLALCSSGCGFFGSKETNNMCSKCYRDHLKATSPLFSSSSSPATASTTDITVPIAPATTAPTPSLKGKEEEATAAASSSAAAAAKPNRCVACRKKVGLLGFECRCGGTFCSTHRHADKHACTFDFKKSDREKIAKENPLIVAPKITKF

SEQ ID NO: 800 - DNA, 480 bp, Populus balsamifera subsp. trichocarpa
  misc_feature: Ceres ANNOT ID no.1460527
  misc_feature: Encodes the peptide sequence at SEQ ID NO 801
atggcagaagaacaacaccgatgccaagaaccacgtctctgcgtaaacaactgcggtttttttggaagcccagcaactcaaaatctgtgttctaaatgttatggtgatcttcgtcaatcacagcccctgaatcagctcctagccccatcatcatctgcttctgtttcttccttttcatccccaaccgtcgatgttataaagaaccagatagctcccgtgttggtggtggaaggtgatgaaaaaggggagtttaaggctgaacctacggttgtggttccacagcagaagccaaataggtgcttgacgtgtaggaggcgcgtagggttgacgggatttaattgcaggtgtggtatggtgttttgtggaacgcataggtacccagaacaacatgattgtgagtttgattttaagagcttaggtaaagaacagatcgctaaggctaatcctgttgttaagggtgagaagcttcaaaggatttaa

SEQ ID NO: 801 - protein, 159 aa, Populus balsamifera subsp. trichocarpa
  misc_feature: Ceres ANNOT ID no.1460527
  misc_feature: Bit score of 356.5 for HMM based on sequences of FIGURE 7.
  misc_feature (100)..(140): Pfam Name: zf-AN1 Pfam Description: AN1-like Zinc finger
  misc_feature (11)..(35): Pfam Name: zf-A20 Pfam Description: A20-like zinc finger
  misc_feature: Functional Homolog Of Ceres SEEDLINE ID no. ME04477 at SEQ ID NO. 742
MAEEQHRCQEPRLCVNNCGFFGSPATQNLCSKCYGDLRQSQPLNQLLAPSSSASVSSFSSPTVDVIKNQIAPVLVVEGDEKGEFKAEPTVVVPQQKPNRCLTCRRRVGLTGFNCRCGMVFCGTHRYPEQHDCEFDFKSLGKEQIAKANPVVKGEKLQRI

SEQ ID NO: 802 - DNA, 819 bp, Zea mays
  misc_feature: Ceres Clone ID no. 1468822
  misc_feature: Encodes the peptide sequence at SEQ ID NO. 803
gctcgctccctccctccctccctcccgcgcggatcacagaagggctcacggtcacggccggcctcccaattcgcaacctcgcctccgcctctcctcctaccccctccgaaaagcaagctccggccgggccgccaccaccaccaccgcgcgcgcgtgcacgcgctcccacacacagacagacagacagacagacagagtgagagacgcacggtggttcggggtctcccttctgccaggcgcacgaggagccatggcgcagcgcgacaagaaggaggagcccacggagctccgggcgccggagatcacgctgtgcgccaacaactgcgggttcccgggtaacccggccacgcagaacctgtgccagagctgcttctcggcgtcgaggtcgccgtcgtcccctacctcctcctcctcttccctggcgtccgcggcgtcgcagccgaggccagcagcgctcgtcgtagacgcggcagcggtggaggcgctggccgctccggcggccgcggccgcgggccagggccaggctacggaagccgcggcgagggcgtccgcgagccggtgctccagctgccggaagcgcgtggggctgacggggttccggtgccgctgcggcgagctcttctgcggcgcgcaccggtactcggaccggcacggctgcagctacgactacaggggcgccgcccgggacgccatcgcccgggagaacccggtggtgcagtggttgagggcccgaaacgatgaacagatgggttggttggattgggttaggtgtatgtatatgtcacacgcaactttggacagaactattatactagtact

SEQ ID NO: 803 - protein, 189 aa, Zea mays
  misc_feature: Ceres Clone ID no. 1468822
  misc_feature (1)..(189): Bit score of 304.0 for hmm based on sequences of FIGURE 15.
  misc_feature (104)..(144): Pfam Name: zf-AN1 Pfam Description: AN1-like Zinc finger
  misc_feature (18)..(42): Pfam Name: zf-A20 Pfam Description: A20-like Zinc finger
  misc_feature: Functional Homolog Of SEQ ID NO. 749
MAQRDKKEEPTELRAPEITLCANNCGFPGNPATQNLCQSCFSASRSPSSPTSSSSSLASAASQPRPAALVVDAAAVEALAAPAAAAAGQGQATEAAARASASRCSSCRKRVGLTGFRCRCGELFCGAHRYSDRHGCSYDYRGAARDAIARENPVVQWLRARNDEQMGWLDWVRCMYMSHATLDRTIILV

SEQ ID NO: 804 - DNA, 519 bp, Sorghum bicolor
  misc_feature: Ceres Annot ID no. 8644540
  misc_feature: Encodes the peptide sequence at SEQ ID NO. 805
atggcacaagagagctggaaacaagagtctgaggaaactggagtccatgcccctgaggccccgattctgtgcataaacaattgtggtttcttcggcagcagcatgacaaacaatatgtgctcgaagtgctatagggacttcatcaagttgatggaaacccctgtggtggagaagaaggttatagcaggggcatcatcctctgcagtgctgccactagaggcagcaaagcgagacgcattgcccaccgctgctgctgctgctgctgctgaagcagccgcagctgtagacgacaagcaagcagcacaggaggagcccccaaagccgccgagcaaccggtgcctgacgtgccgcaagaaggtggggctgactgggttccagtgccgctgcggtggaaccttctgctccatgcaccgctacacggactcccaccagtgcaccttcgactacaagacagcggccagggagcagatcgccaagcagaaccctgtcgtgatggccgagaagatcaacaagatctga

SEQ ID NO: 805 - protein, 172 aa, Sorghum bicolor
  misc_feature: Ceres Annot ID no. 8644540
  misc_feature (1)..(172): Bit score of 333.4 for hmm based on sequences of FIGURE 7.
  misc_feature (113)..(153): Pfam Name: zf-AN1 Pfam Description: AN1-like Zinc finger
  misc_feature (21)..(45): Pfam Name: zf-A20 Pfam Description: A20-like zinc finger
  misc_feature: Functional Homolog Of SEQ ID NO. 742
MAQESWKQESEETGVHAPEAPILCINNCGFFGSSMTNNMCSKCYRDFIKLMETPVVEKKVIAGASSSAVLPLEAAKRDALPTAAAAAAAEAAAAVDDKQAAQEEPPKPPSNRCLTCRKKVGLTGFQCRCGGTFCSMHRYTDSHQCTFDYKTAAREQIAKQNPVVMAEKINKI

SEQ ID NO: 806 - DNA, 504 bp, Populus balsamifera subsp. trichocarpa
  misc_feature: Ceres ANNOT ID no.1450673
  misc_feature: Encodes the peptide sequence at SEQ ID NO 807
atggcagaagaacaacacagatgccaagaacaacgactctgcgtaaacaactgcggcttttatgggagccaagcaacagaaaatctttgttccaagtgttaccgtgatcttcatcaatcacagcccttgaatcatcagctgctaaacccatcatcatcatcggctgcttctgtttcctcctttgcatccccagccgttgatgttctaaaagtcaacaccaaccagaaagctcctgttgtggtggtgggagatgataaaaaagatgaggtaaaggcaggagagcctgcggctgggaagcagcagcagcataagccaaataggtgcttgacgtgtaggaggcgcgtggggttgacggggttcaagtgcaggtgtggtatggtgttttgtggaacacataggtacccggaacagcatgattgcgaatttgattttaagagtttagggaaacaacagattgctaaggctaatcccgttgttaagggagagaaactccaaaaaatttaa

SEQ ID NO: 807 - protein, 167 aa, Populus balsamifera subsp. trichocarpa
  misc_feature: Ceres ANNOT ID no.1450673
  misc_feature: Bit score of 303.5 for HMM based on sequences of FIGURE 7.
  misc_feature (108)..(148): Pfam Name: zf-AN1 Pfam Description: AN1-like Zinc finger
  misc_feature (11)..(35): Pfam Name: zf-A20 Pfam Description: A20-like zinc finger
  misc_feature: Functional Homolog Of Ceres SEEDLINE ID no. ME04477 at SEQ ID NO. 742
MAEEQHRCQEQRLCVNNCGFYGSQATENLCSKCYRDLHQSQPLNHQLLNPSSSSAASVSSFASPAVDVLKVNTNQKAPVVVVGDDKKDEVKAGEPAAGKQQQHKPNRCLTCRRRVGLTGFKCRCGMVFCGTHRYPEQHDCEFDFKSLGKQQIAKANPVVKGEKLQKI

SEQ ID NO: 808 - protein, 180 aa, Picea sitchensis
  misc_feature: Public GI ID no. 116778802
  misc_feature (1)..(180): Bit score of 274.6 for hmm based on sequences of FIGURE 7.
  misc_feature (121)..(161): Pfam Name: zf-AN1 Pfam Description: AN1-like Zinc finger
  misc_feature (21)..(45): Pfam Name: zf-A20 Pfam Description: A20-like zinc finger
  misc_feature: Functional Homolog Of SEQ ID NO. 742
MAQESWNREKEETGCQVPEGLIRCANNCGFFGSPATMSLCSKCYREFVLLNSPKSSFDKPQQQQIQGEVSIPRPDVGDEEIRSKYLAVDGSGPSCSTAAHQLEPQQQQNPPPPPPRQTNRCFSCRKRVGLTGFRCRCGDMFCALHRYSDKHNCTYDYKTAGREAIAKANPLVKADKILRF

SEQ ID NO: 809 - protein, 170 aa, Picea sitchensis
  misc_feature: Public GI ID no. 116778893
  misc_feature (1)..(170): Bit score of 291.2 for hmm based on sequences of FIGURE 7.
  misc_feature (111)..(151): Pfam Name: zf-AN1 Pfam Description: AN1-like Zinc finger
  misc_feature (21)..(45): Pfam Name: zf-A20 Pfam Description: A20-like zinc finger
  misc_feature: Functional Homolog Of SEQ ID NO. 742
MAQESWKNMGEDRGRQPPGGPVLCSNKCGFFGSSATMNMCSKCYRDHFLAQTQASAVKSAVEKSLSLDIDSSKALRFDATGVRNPAEIVGSSSDDGNSVSSEEPPRVSNRCQSCRKRVGLTGFKCRCGYVFCSLHRYSDKHGCSFDYKEAGRQEIEKANPVVKAEKIQKI

SEQ ID NO: 810 - protein, 181 aa, Picea sitchensis
  misc_feature: Public GI ID no. 116778998
  misc_feature (1)..(181): Bit score of 316.1 for hmm based on sequences of FIGURE 7.
  misc_feature (122)..(162): Pfam Name: zf-AN1 Pfam Description: AN1-like Zinc finger
  misc_feature (21)..(45): Pfam Name: zf-A20 Pfam Description: A20-like zinc finger
  misc_feature: Functional Homolog Of SEQ ID NO. 742
MDQENWNIGADGTGCQAPEGHTLCANNCGFFGSSATRNLCSKCYRDLIMKEAQATSAMAAVEKSFAAGSPMDEVPLSSPDAIVQQNRVQISAAVAGVSSVQLADSGSSSSSPQPPAETPNRCFSCRKRVGLTGFKCRCENTFCGLHRYAEKHSCSFDFKAAGREAIAKANPVVKAAKIDKL

SEQ ID NO: 811 - protein, 168 aa, Brassica rapa
  misc_feature: Public GI ID no. 157849766
  misc_feature (1)..(168): Bit score of 367.1 for hmm based on sequences of FIGURE 7.
  misc_feature (109)..(149): Pfam Name: zf-AN1 Pfam Description: AN1-like Zinc finger
  misc_feature (15)..(39): Pfam Name: zf-A20 Pfam Description: A20-like zinc finger
  misc_feature: Functional Homolog Of SEQ ID NO. 742
MDHDKTGCQSPPEGPKLCINNCGFFGSAATMNMCSKCHKTILFQQEQGAKLASAVSGSPSNILKETFTAALVDAETKSIEPVAVSVQAVAEVVAPEEAAAKPKEGPSRCTTCNKRVGLTGFKCRCGDLFCGTHRYADVHNCSFDYHVAAQEAIAKANPVVKADKLDKI

SEQ ID NO: 812 - protein, 160 aa, Chlamydomonas reinhardtii
  misc_feature: Public GI ID no. 159474166
  misc_feature (1)..(160): Bit score of 152.4 for hmm based on sequences of FIGURE 7.
  misc_feature (101)..(141): Pfam Name: zf-AN1 Pfam Description: AN1-like Zinc finger
  misc_feature (9)..(33): Pfam Name: zf-A20 Pfam Description: A20-like zinc finger
  misc_feature: Functional Homolog Of SEQ ID NO. 742
MEREQASSPQLCEKGCGFFANVGCGGMCSKCHREEARQHANAQATSSQPKPVEVAASRPVHESFPQPAAPSEAVASPVAEASTSSGDASPSATKSANPSRCLCCKKKVGLTGFKCKCGDVFCGTHRYAESHNCPFDYKTVHKEKLASNNPVVQASKVQKI

SEQ ID NO: 813 - protein, 188 aa, Physcomitrella patens subsp. patens
  misc_feature: Public GI ID no. 168036656
  misc_feature (1)..(188): Bit score of 250.6 for hmm based on sequences of FIGURE 7.
  misc_feature (129)..(169): Pfam Name: zf-AN1 Pfam Description: AN1-like Zinc finger
  misc_feature (18)..(42): Pfam Name: zf-A20 Pfam Description: A20-like zinc finger
  misc_feature: Functional Homolog Of SEQ ID NO. 742
MATERVSQETTSQAPEGPVMCKNLCGFFGSQATMGLCSKCYRETVMQAKMTALAEQATQAAQATSATAAAVQPPAPVHETKLTCEVERTMIVPHQSSSYQQDLVTPAAAAPQAVKSSIAAPSRPEPNRCGSCRKRVGLTGFKCRCGNLYCALHRYSDKHTCTYDYKAAGQEAIAKANPLVVAEKVVKF

SEQ ID NO: 814 - DNA, 471 bp, Populus balsamifera subsp. trichocarpa
  misc_feature: Ceres ANNOT ID no.1456578
  misc_feature: Encodes the peptide sequence at SEQ ID NO 815
atggagcaagaatcccaaaagagaaagctagaagacagcagcagtaacgaggcacaaaacacgccaattctttgtgtgaataactgtggtttttttggaagccccaacactaataatctctgctctaaatgttacaaagaattccttctaacccaacaagacacaactacaacaacaattgatgttccagttcatgttgccgaaaacagtgcagcagcagcagcagaagttgaagggcaacaagaaggaggtgaagaggagaagcggccggtggtggtggcaaacaggtgcaacttctgcaggaaaaaagtgggcttgacagggttcaagtgccgttgtggatacactttctgttcgcagcacagatattcggacaagcataactgtgtgttcgattacaagagtgctggacaggatgctattgctaaagccaatcctgttgtcaaggcagataagattgataagatatga

SEQ ID NO: 815 - protein, 156 aa, Populus balsamifera subsp. trichocarpa
  misc_feature: Ceres ANNOT ID no.1456578
  misc_feature: Bit score of 239.4 for HMM based on sequences of FIGURE 7.
  misc_feature (22)..(46): Pfam Name: zf-A20 Pfam Description: A20-like zinc finger
  misc_feature (97)..(137): Pfam Name: zf-AN1 Pfam Description: AN1-like Zinc finger
  misc_feature: Functional Homolog Of Ceres SEEDLINE ID no. ME04477 at SEQ ID NO. 742
MEQESQKRKLEDSSSNEAQNTPILCVNNCGFFGSPNTNNLCSKCYKEFLLTQQDTTTTTIDVPVHVAENSAAAAAEVEGQQEGGEEEKRPVVVANRCNFCRKKVGLTGFKCRCGYTFCSQHRYSDKHNCVFDYKSAGQDAIAKANPVVKADKIDKI

SEQ ID NO: 816 - protein, 172 aa, Physcomitrella patens subsp. patens
  misc_feature: Public GI ID no. 168053490
  misc_feature (1)..(172): Bit score of 251.7 for hmm based on sequences of FIGURE 7.
  misc_feature (113)..(153): Pfam Name: zf-AN1 Pfam Description: AN1-like Zinc finger
  misc_feature (21)..(45): Pfam Name: zf-A20 Pfam Description: A20-like zinc finger
  misc_feature: Functional Homolog Of SEQ ID NO. 742
MAQYGRKPDTEETNCQVPEGPVRCTNNCGFFGSAVTMGMCSKCYRDFVLSQSRTSSAKIAGASPPVYETQEPVADRAQIQNSCLSSTQPEAAGASSGASASGQDPSRSRPNRCFSCKKRLGLTGFECRCGNLFCSAHRYSDKHSCTFDYKLAGRDSISKANPVVKADKINKI

SEQ ID NO: 817 - protein, 165 aa, Lotus japonicus
  misc_feature: Public GI ID no. 193237563
  misc_feature (1)..(165): Bit score of 325.1 for hmm based on sequences of FIGURE 7.
  misc_feature (106)..(146): Pfam Name: zf-AN1 Pfam Description: AN1-like Zinc finger
  misc_feature (13)..(37): Pfam Name: zf-A20 Pfam Description: A20-like zinc finger
  misc_feature: Functional Homolog Of SEQ ID NO. 742
MAEEHRCEAPEGHRLCVNNCGFSGSPATMDLCSKCYRDIRLKEQQEASTKSTIETALSSSSSVAKPPSSTSSPSPAVDLAPPAKAETASISLTAGPILQAAQPNRCATCRKRVGLTGFKCRCEVTFCGAHRYPEKHACSFDFKTVGREAIARENPVVRAEKLRRI

SEQ ID NO: 818 - DNA, 902 bp, Zea mays
  misc_feature: Ceres Clone ID no. 100879386
  misc_feature: Encodes the peptide sequence at SEQ ID NO. 819
tatattcagtgatggaacacaaggaggccggctgccagcagccggagggcccaatcctatgcatcaataactgtggtttctttggaagcgctgccaccatgaacatgtgctccaagtgccacaaggagatgataatgaagcaggagcaggcccagttggctgcctcctccatcgatagcattgtcaatggcggtgataatgggaaaggacctgcaattgctgcaactgtaggtgtggcagttcctcaagtcgaggagaagactatcgccgtgcagcctatgcatgtcgctgaaaccagcgaggctgctgctgttatcgcgaaggccaaggaaggcccaaaccggtgcgcaacctgtaggaagcgtgttgggttgacgggttttaactgccgatgcgggaacacgtactgttcgatgcaccgctactccgacaaacacgactgccagttcgactatcgaactgcagctagggacgctatcgccaaggccaatccagtggtgaaggcggagaagcttgacaagatctgaggcgggggcattgggtaacgaaaaatggttgcgatctgcaagaattcagcatgtctctttgctgctttatcattgaacttcccattcttgtcttgctgtcacgtcccctggggttcaatactatgatgcgcacagcatcctggcagctgcaagaattcatccccagtcgagtcacgaaaatggtttgcgtgttgactatgtcgtgtaagcttattcagttattcttggtggtttgggtcggtatcgtgtcattccccgtttaggtagctctgtaatctactattctcaatttctcatgtgtgttgccttccaatcagtaatagtaatcagcaattgtctgccatatctcctacaagtatattttccagttctatt

SEQ ID NO: 819 - protein, 171 aa, Zea mays
  misc_feature: Ceres Clone ID no. 100879386
  misc_feature (1)..(171): Bit score of 364.0 for hmm based on sequences of FIGURE 7.
  misc_feature (112)..(152): Pfam Name: zf-AN1 Pfam Description: AN1-like Zinc finger
  misc_feature (14)..(38): Pfam Name: zf-A20 Pfam Description: A20-like zinc finger
  misc_feature: Functional Homolog Of SEQ ID NO. 742
MEHKEAGCQQPEGPILCINNCGFFGSAATMNMCSKCHKEMIMKQEQAQLAASSIDSIVNGGDNGKGPAIAATVGVAVPQVEEKTIAVQPMHVAETSEAAAVIAKAKEGPNRCATCRKRVGLTGFNCRCGNTYCSMHRYSDKHDCQFDYRTAARDAIAKANPVVKAEKLDKI

SEQ ID NO: 820 - DNA, 802 bp, Glycine max
  misc_feature: Ceres Clone ID no. 532446
  misc_feature: Encodes the peptide sequence at SEQ ID NO. 821
atagttttccttctttctttctttgtgaaaaaacaaaaagtccaaaccatggctcagaaaaccgagaaagaagaaaccgacttcaaggttcccgaaacgattacgctttgcgttaacaactgcggcgtcaccggaaaccctgctacgaataacatgtgtcagaagtgcttcaccgccttcaccacctctaccgccaccacgtccggcgccggaggtgccggaatagcttctccggctaccagatccggcatctccgcgcgtccactgaagagatcttttcccgaggagccctcgccgccggcggatcctccgtcttcagaccagacgaccccgtcggaggcgaagcgcgtggtgaaccgctgctccggctgcaggaggaaggtcggactcaccggatttcggtgccgatgcggcgagctcttctgcgccgagcaccggtactccgaccgccacgactgcagctacgactacaaagccgccggaagagaagccatcgcgagggagaatccggtgattagagccgcgaagatcgtcaaagtctgaaaaaaaacaaaaaagaaggaaaaaacccgaacggaacggaatctcaaaacgacgtcgttgacggttgacctttcgcgcgatcgggttcaggtcacgggtttcgctttttttcttttcagatttatatatagagagaagaaaaaaaaagtagcagataacaggtttgagagagagagagagagagtgtgaggttttagattgagagagagagcgagagagagagattgttgctgaaaagaagatgaagaagaatttatcc

SEQ ID NO: 821 - protein, 164 aa, Glycine max
  misc_feature: Ceres Clone ID no. 532446
  misc_feature (1)..(164): Bit score of 313.3 for hmm based on sequences of FIGURE 15.
  misc_feature (105)..(145): Pfam Name: zf-AN1 Pfam Description: AN1-like Zinc finger
  misc_feature (18)..(42): Pfam Name: zf-A20 Pfam Description: A20-like zinc finger
  misc_feature: Functional Homolog Of SEQ ID NO. 749
MAQKTEKEETDFKVPETITLCVNNCGVTGNPATNNMCQKCFTAFTTSTATTSGAGGAGIASPATRSGISARPLKRSFPEEPSPPADPPSSDQTTPSEAKRVVNRCSGCRRKVGLTGFRCRCGELFCAEHRYSDRHDCSYDYKAAGREAIARENPVIRAAKIVKV

SEQ ID NO: 822 - DNA, 668 bp, Miscanthus x giganteus
  misc_feature: Ceres Clone ID no. 2055733
  misc_feature: Encodes the peptide sequence at SEQ ID NO. 823
tttttttcgaagcccaccgaattccctgcgattcctctcccctcgcctcctcgtcttcctctaggggatcgccggagaggaatcgcagagggccgtctcatccgagttaaggaagccatggagcacaaggagactggatgccaggcccccgagggacccatcctttgcatcaataactgcggcttcttcggaagcgcagctaccatgaacatgtgctccaagtgccacaaggagatgataatgaagcaggagcaggccaagctggctgcctcctctatcgacagcatcgtcaatggcaacgatgctgtcatggaaccagttgttgctggcaacacagtggtagctgttgctccagttgagttgcaaacaatgaacgtgcagcccactgatgttgctggacctagcgagggggcggcggtgatctccaaagggaaggtagggccaaaccggtgcagcacttgcaggaagagggttggacttacaggattcaactgccggtgtgggaacttgtactgtgcactccaccgctactccgacaagcatgactgcaagtttgactatcggactgctgctagggatgccattgccaaggctaatccagtggtgaaggcggacaagctcgacaagatctagggtttcctacggttggctcaggaagattgcaacct

SEQ ID NO: 823 - protein, 171 aa, Miscanthus x giganteus
  misc_feature: Ceres Clone ID no. 2055733
  misc_feature (1)..(171): Bit score of 356.5 for hmm based on sequences of FIGURE 7.
  misc_feature (112)..(152): Pfam Name: zf-AN1 Pfam Description: AN1-like Zinc finger
  misc_feature (14)..(38): Pfam Name: zf-A20 Pfam Description: A20-like zinc finger
  misc_feature: Functional Homolog Of SEQ ID NO. 742
MEHKETGCQAPEGPILCINNCGFFGSAATMNMCSKCHKEMIMKQEQAKLAASSIDSIVNGNDAVMEPVVAGNTVVAVAPVELQTMNVQPTDVAGPSEGAAVISKGKVGPNRCSTCRKRVGLTGFNCRCGNLYCALHRYSDKHDCKFDYRTAARDAIAKANPVVKADKLDKI

SEQ ID NO: 824 - DNA, 723 bp, Miscanthus x giganteus
  misc_feature: Ceres Clone ID no. 2056478
  misc_feature: Encodes the peptide sequence at SEQ ID NO. 825
catttcgaagcccaccgaactccctgcgattcctctcccctcgcctcctcgtcttcccctaggggatcgccggagaggaatcgcaaagagggccgtctcgtccgagttaaggaagccatggagcacaaggagactggatgccaggctcccatcctttgcatcaataactgcggcttcttcggcagtgcagctaccatgaacatgtgctccaagtgccacaaggagatgataacgaagcaggaccatgccaagctggctgcctcctctatcgacagcatcgtcaatggcaacgatgctgtcatggaaccagttgtttctggcaacacagtggtagctgttgctcaagttgagttgcaaacgatgaacgtgcagcccactgatgttgctggacctagcgagggggcggcggtgatctccaaagggaaggtagggccgaaccggtgcagcacttgcaggaagagggttagacttacagggttcaactgccggtgtgggaacttgtactgtgcactccaccgctactccgacaagcatgactgcaagtttgactatcggactgctgctagggatgccattgccaaggctaatccagtggtgaaggcggacaagctcgacaagatctagggtttcctacggttggctcaaggaagattgcaacctgtggtacttcttcatcatgcgggattgctgctttgcccatgcctttccctttcatgtttgctg

SEQ ID NO: 825 - protein, 168 aa, Miscanthus x giganteus
  misc_feature: Ceres Clone ID no. 2056478
  misc_feature (1)..(168): Bit score of 324.7 for hmm based on sequences of FIGURE 7.
  misc_feature (109)..(149): Pfam Name: zf-AN1 Pfam Description: AN1-like Zinc finger
  misc_feature (11)..(35): Pfam Name: zf-A20 Pfam Description: A20-like zinc finger
  misc_feature: Functional Homolog Of SEQ ID NO. 742
MEHKETGCQAPILCINNCGFFGSAATMNMCSKCHKEMITKQDHAKLAASSIDSIVNGNDAVMEPVVSGNTVVAVAQVELQTMNVQPTDVAGPSEGAAVISKGKVGPNRCSTCRKRVRLTGFNCRCGNLYCALHRYSDKHDCKFDYRTAARDAIAKANPVVKADKLDKI

SEQ ID NO: 826 - DNA, 1513 bp, Triticum aestivum
  misc_feature: Ceres Clone ID no. 913923
  misc_feature: Encodes the peptide sequence at SEQ ID NO. 827
agcaaaccaacttcctctccttcctccgctcccaccgaaccatcctcatcacagcctctccttctcttcgttcgctgctcccgtcgtagcccacgcatcttgttgcttttctccaggcgcttcttcagtcttcctccctgtgtcggtccgcgatctcgtcatgatgaaccacgccacctttgctgccgaggacgcggtcaccgccgtgacggcgccggcgcagccgggtcgccattttgtgtcgctcccgccgcggagggcgcgcgactgcaggaaggcctccctgggccgcatggacctcgccacctcggcggtgctgatggccgggtctctgctggactcgatgaaggcctcctcgccccgccacgccatgtcccccgccggcgccgaccacgaggagtggatcgagaagcacccctcagcattggagtggttcgagggcgtgctcgcggcggccgaggggaagcagatcgtcatgttcctcgactacgacggcaccctttcaccgatcgtcgaggaccccgaccgcgccgtcatgaccgaggagatgagggacgcggtgaggggcgtcgcccagcatttcccgaccgccatcgtgagtgggagatgcagagacaaggtgttcaactttgtgaaactggaggagctgtactatgccgggagccacggcatggacatcaagggccccaccaaagtgtctaaccacaaggcaaaggctgacgaggttctgtgccagccggcgaccgagttcttgcctgtcattcaggaggtgtatgagacgctgaccgcgaagatggagtccatcccgggggccatggtggagaacaacaagttctgcctctcggtgcacttccgctgcgtcgaggaggcggaatgggacgctctgggcagggaggtgaaggcggtgctggacgactacccgaaactctgcctcaccaaggggagaaaggtcctcgagatccggcccttcatcaagtggaacaaaggaaacgcccttaagttcttgctcaagtctctcggttatgcagggcgtggcgacgttttcccgatatatattggagatgaccgcacagacgaggatgcgttcaaggtgctgcgcaacatgggacaaggcatcgggatccttgtgaccaagtttcccaaggacactagcgcatcgtactctctgcgtgagcctgctgaggtaaaggagttcatgcgcaagctagtgaagagcaacggggtaaagaagggttaattcatcaatcaacaaccttctagctctaactcaacatgaagatcgagcaggctatatagcttgtacatcaagtctagcttgtttcctttttggacttggtgttgtctctcctttcatctagtagaacaatgcatgcatgcgtgttagggtcgatgtagaagatccagatcgatcaatgacccatgctaggccttggctctgaaggtttctattactgtatccttctctcaaggtcttgtaattagccttcccttagctatgacagaaatggtattg

SEQ ID NO: 827 - protein, 358 aa, Triticum aestivum
  misc_feature: Ceres Clone ID no. 913923
  misc_feature (1)..(358): Bit score of 558.4 for hmm based on sequences of FIGURE 9.
  misc_feature (107)..(340): Pfam Name: Trehalose_PPase Pfam Description: Trehalose-phosphatase
  misc_feature: Functional Homolog Of SEQ ID NO. 1129
MMNHATFAAEDAVTAVTAPAQPGRHFVSLPPRRARDCRKASLGRMDLATSAVLMAGSLLDSMKASSPRHAMSPAGADHEEWIEKHPSALEWFEGVLAAAEGKQIVMFLDYDGTLSPIVEDPDRAVMTEEMRDAVRGVAQHFPTAIVSGRCRDKVFNFVKLEELYYAGSHGMDIKGPTKVSNHKAKADEVLCQPATEFLPVIQEVYETLTAKMESIPGAMVENNKFCLSVHFRCVEEAEWDALGREVKAVLDDYPKLCLTKGRKVLEIRPFIKWNKGNALKFLLKSLGYAGRGDVFPIYIGDDRTDEDAFKVLRNMGQGIGILVTKFPKDTSASYSLREPAEVKEFMRKLVKSNGVKKG

SEQ ID NO: 828 - DNA, 1092 bp, Sorghum bicolor
  misc_feature: Ceres Annot ID no. 8656803
  misc_feature: Encodes the peptide sequence at SEQ ID NO. 829
atgacgaagcacgccgcctaccccagcgaggacgtggtcgccgttgtggcggcgccagtgccggtgagccggcatttcacatcgttcccgccgctaaaggatgcccctctcgactgcaagaagcatgttgtcgtggacctctccgcttctagggatgccatcatgggcggctcctggttcgagtccatgaaggcttcatcgccgcggcacgccgatgacgccgagcaccacggcgattggatggagaagcacccatcagcattggcgcagtttgaggcgctgctggccgccgccaaggggaagcagatcgtgttgttcctagactacgatggcaccctgtcaccaatcgtcgaggaccccgaccgcgccgtcatgtcagaagagatgagagaagccgtgcggcgtgtcgcggagcacttccccaccgcaattgtgagcggaagatgcagggacaaggtgttcaacttcgtgaagctgacggagctgtactacgccggaagccatggcatggacatccagggtcccgccaatcaccacctccaggcaaatgctgaagttgtccattaccaagctggaactgagtttctgcccgtcatcgaagaggtgtttggcacgctgacggcgaagatggaggcgatcgccggcgccaaggtggagaacaacaagtactgcctgtccgtccacttccgctgcgtcagggaggaggaatggaatgccgtgaacgaggaggtcaggtcggtgctcaaggactaccccaacctcaagctcactcacggcagaaaggtcctggagattcgcccgtccataaagtgggacaagggcaaggcccttgagttcttgctcaagtctcttggctatgctgggcgcaacgacgtcttcccgatttacatcggagatgatcgcactgacgaggacgctttcaagatgcttcgcaacatgggacagggcatcggaatcctggtgtcgaggctccctaaggagacggtggcatcctactcgctgagtgaccctaccgaggtcaaggagttcctctgcaagctggagaagtcggccaaggaggacgcgccagacctagctagtagtggattgtag

SEQ ID NO: 829 - protein, 363 aa, Sorghum bicolor
  misc_feature: Ceres Annot ID no. 8656803
  misc_feature (1)..(363): Bit score of 567.4 for hmm based on sequences of FIGURE 9.
  misc_feature (106)..(338): Pfam Name: Trehalose_PPase Pfam Description: Trehalose-phosphatase
  misc_feature: Functional Homolog Of SEQ ID NO. 1129
MTKHAAYPSEDVVAVVAAPVPVSRHFTSFPPLKDAPLDCKKHVVVDLSASRDAIMGGSWFESMKASSPRHADDAEHHGDWMEKHPSALAQFEALLAAAKGKQIVLFLDYDGTLSPIVEDPDRAVMSEEMREAVRRVAEHFPTAIVSGRCRDKVFNFVKLTELYYAGSHGMDIQGPANHHLQANAEVVHYQAGTEFLPVIEEVFGTLTAKMEAIAGAKVENNKYCLSVHFRCVREEEWNAVNEEVRSVLKDYPNLKLTHGRKVLEIRPSIKWDKGKALEFLLKSLGYAGRNDVFPIYIGDDRTDEDAFKMLRNMGQGIGILVSRLPKETVASYSLSDPTEVKEFLCKLEKSAKEDAPDLASSGL

SEQ ID NO: 830 - DNA, 1119 bp, Populus balsamifera subsp. trichocarpa
  misc_feature: Ceres ANNOT ID no.1496359
  misc_feature: Encodes the peptide sequence at SEQ ID NO 781
atgacaaaccagaatgtggttgtgcctgatgccaaacagggtattgatatcaccatcgcaatggtgctgcccaagtctctgttttcacctgttgtgccaaagccattgcctgccgctcctggtgggtatttcacaataacccgaaagaggttctcgaagaagacagaaactggaggcaaaatcagttcctgggttgattctatgagggattcttcacctacccgtgtcaaatccaccacttctttatcagaaactgaagagaaaaattcttggattgtaaaccatccttctgctctgaacatgtttgagcaaatagtgaaaggctcaaagggaaagcagattgtgatgttccttgattatgatggtacactgtcacccattgttgaagatcctgacagagcattcatgaccaatgagatgagagaagctgtcagggacgttgctagatactttcccacggctatagtgacgggaaggtgtagaaaaaaggtgtatagctttgtaagattggcagggctttattatgctggtagccatggcatggacatcaagggaccatccaaaaataattgcaaatacgaaaaaggtggtgtactctttcaacctgccagtgaatttttacccatgattgatgaggtgtacaatgtcttgttggagagaacaaaatctatcccaggagctaaagtagaaaacaacaaattttgcgtatccgtacactttcgatgtgttgaggaaaagatgtgggctatattagtagagcaagtccgatcagttctcaatgattatcccaagcttagattaactcaagggaggaaggttttagagatccgacccaccattaaatgggacaagggcaaagctcttgaattcttgttagagtcattaggatatgccaattctactgacgtttttccggtctatattggagatgatcgaactgatgaggacgcattcaaggttctaagaaacagggggcaagggcttgggattcttgtttctaaagttcccaaggaaacaaatgcctcttattctctacaggaaccaaaagaggttaaagacttcttacggcgattggtggagtggaagcgatcttcgttacaaggacaacgtagagcgtaa

SEQ ID NO: 831 - DNA, 1155 bp, Arabidopsis thaliana
  misc_feature: Ceres CLONE ID no.13007
  misc_feature: Encodes the peptide sequence at SEQ ID NO 832
atcgatcactgaatcttcttcttcttcttcttcttcttcttcttcttcttcttcttccttctctcaagaacaggtaaaactctctcctcttctccttctttttctctcctctctcttctctcttttaacaaaaaaaaaactgtcttttcttcatttctgttcttttttttggttgccgagaaaaacagaggataattttccgatctctgttttttttttctcggtgaccagaatcggttggttctgttttttttttttttttttccttctttgttattgttatcttattaatgaatcttttttgttgttataatttacagattttttttaaacgagcttgatcaataaattctctcaagatctatggcagaagagcatcgatgtcagacaccagaaagcaaccgtctctgtgttaacaactgtggcttcctcggcagctccgccaccatgaatctctgttctaattgttacggcgatctttgtctcaaacaacaacaacaatcctcctccatcaaatccaccgttgaatcttccctctctgtatctcctccgtcgtcatcatcatcggagatctcttctccgatcatccctcctctccttaaaaatccatcagtcaagctagaggtaccggagaaaaaggcggtgatttcgctgccgacgacggagcagaatcagcaacagaggccgaatcggtgcacgacgtgtaggaaacgggtcgggttaaccggattcaagtgccggtgcggtacgatgttttgcggggttcataggtacccggagatccatggatgcagctacgatttcaaatcggccggacgtgaagagatcgcgaaagcgaatccgttggtgaaagcagcgaagcttcagaagatatgatcagagccgttcgatgcgttgacttttcctctcgtaagtcttcatttctacgcgtatgtgtgtcctccgtcccccgagaaatacggatggtgtcgatttgattgatctcagccgttggatcaaaaatggtttattattgtaaaagattgattatgtatttatcaaagggacacgtgtcacgtggttttaggatggagacgctttcgctttctctccttcattttattttctttttcctttcagaaagaaataagattattcgcgttggctttttctttt

SEQ ID NO: 832 - protein, 170 aa, Arabidopsis thaliana
  misc_feature: Ceres CLONE ID no.13007
  misc_feature: Bit score of 342.8 for HMM based on sequences of FIGURE 7.
  misc_feature (111)..(151): Pfam Name: zf-AN1 Pfam Description: AN1-like Zinc finger
  misc_feature (13)..(37): Pfam Name: zf-A20 Pfam Description: A20-like zinc finger
  misc_feature: Functional Homolog Of Ceres SEEDLINE ID no. ME04477 at SEQ ID NO. 742
MAEEHRCQTPESNRLCVNNCGFLGSSATMNLCSNCYGDLCLKQQQQSSSIKSTVESSLSVSPPSSSSSEISSPIIPPLLKNPSVKLEVPEKKAVISLPTTEQNQQQRPNRCTTCRKRVGLTGFKCRCGTMFCGVHRYPEIHGCSYDFKSAGREEIAKANPLVKAAKLQKI

SEQ ID NO: 833 - DNA, 896 bp, Arabidopsis thaliana
  misc_feature: Ceres CLONE ID no.5522
  misc_feature: Encodes the peptide sequence at SEQ ID NO 834
atcgatcactgaatcttcttcttcttmttcttmttcttcttccttctctcaagaacagattttttttaaacgagcttgatcaataaattctctcaagatctatggcggaagagcatcgatgtcagacaccagaaagcaaccgtctctgtgttaacaactgtggcttcctcggcagctccgccaccatgaatctctgttctaattgttacggcgatctttgtstcaaacaacaacaacaatcctcctccatcaaatccaccgttgaatcttccctctctttatctcctccgtcgtcatcatcatcggagatctcttctccgatcatccctcctctccttaaaaatccatcagtcaagctagaggtaccggagaaaaaggcggtgatttcgctgccgacgacggagcagaatcagcaacagaggccgaatcggtgcacgacgtgtaggaaacgggtcgggttaaccggattcaagtgccggtgcggtacgatgttttgcggggttcataggtacccggagatccatggatgcagctacgatttcaaatcggccggacgtgaagagatcgcgaaagcgaatccgttggtgaaagcagcgaagcttcagaagatatgatcagagccgttcgatgcgttgacttttcctctcgtaatcttcatttctacgcgtatgtgtgtcctccgtcccccgagaaatacggatggtgtcgatttgattgatctcagccgttggatcaaaaatggtttattattgtaaaagattgattatgtattaatcaaagggacacgtgtcacgtggttttaggatggagacgctttcgctttctctccttcattttattttctttttcctttcagaaagaaataagattattcgcgttggctttttctttttatc

SEQ ID NO: 834 - protein, 170 aa, Arabidopsis thaliana
  misc_feature: Ceres CLONE ID no.5522
  misc_feature: Bit score of 340.2 for HMM based on sequences of FIGURE 7.
  misc_feature (111)..(151): Pfam Name: zf-AN1 Pfam Description: AN1-like Zinc finger
  misc_feature (13)..(37): Pfam Name: zf-A20 Pfam Description: A20-like zinc finger
  misc_feature: Functional Homolog Of Ceres SEEDLINE ID no. ME04477 at SEQ ID NO. 742
  misc_feature (41)..(41): Xaa is any aa, unknown, or other
MAEEHRCQTPESNRLCVNNCGFLGSSATMNLCSNCYGDLCXKQQQQSSSIKSTVESSLSLSPPSSSSSEISSPIIPPLLKNPSVKLEVPEKKAVISLPTTEQNQQQRPNRCTTCRKRVGLTGFKCRCGTMFCGVHRYPEIHGCSYDFKSAGREEIAKANPLVKAAKLQKI

SEQ ID NO: 835 - DNA, 1032 bp, Arabidopsis thaliana
  misc_feature: Ceres CLONE ID no.30543
  misc_feature: Encodes the peptide sequence at SEQ ID NO 836
ctttttttctcttcccaaattctctcatcgatcactgaatcgttcttcttcttcttcttcttcttcttcttcttcttcttcttccttctctcaagaacagattttttttaaacgagcttgatcaataaattctctcaagatctatggcggaagagcatcgatgtcagacaccagaaagcaaccgtctctgtgttaacaactgtggcttcctcggcagctccgccaccatgaatctctgttctaattgttacggcgatctttgtctcaaacaacaacaacaatcctcctccatcaaatccaccgttgaatcttccctctctgtatctcctccgtcgtcatcatcatcggagatctcttctccgatcatccctcctctccttaaaaatccatcagtcaagctagaggtaccggagaaaaaggcggtgatttcgctgccgacgacggagcagaatcagcaacagaggccgaatcggtgcacgacgtgtaggaaacgggtcgggttaaccggattcaagtgccggttcggtacgatgttttgcggggttcataggtacccggagatccatggatgcagctacgatttcaaatcggccggacgtgaagagatcgcgaaagcgaatccgttggtgaaagcagcgaagcttcagaagatatgatcagagccgttcgatgcgttgacttttcctctcgtaagtcttcatttctacgcgtatgtgtgtcctccgtcccccgagaaatacggatggtgtcgatttgattgatctcagccgttggatcaaaaatggtttattattgtaaaagattgattatgtatttatcaaagggacacgtgtcacgtggttttaggatggagacgctttcgctttctctccttcattttattttctttttcctttcagaaagaaataagattattcgcgttggctttttctttttattaaattccggcttattattattattattattgtgtggcttttgcgtttacaaagtctattcagaaaaataaaaaaaatgatattaatttcccac

SEQ ID NO: 836 - protein, 170 aa, Arabidopsis thaliana
  misc_feature: Ceres CLONE ID no.30543
  misc_feature: Bit score of 332.4 for HMM based on sequences of FIGURE 7.
  misc_feature (111)..(151): Pfam Name: zf-AN1 Pfam Description: AN1-like Zinc finger
  misc_feature (13)..(37): Pfam Name: zf-A20 Pfam Description: A20-like zinc finger
  misc_feature: Functional Homolog Of Ceres SEEDLINE ID no. ME04477 at SEQ ID NO. 742
MAEEHRCQTPESNRLCVNNCGFLGSSATMNLCSNCYGDLCLKQQQQSSSIKSTVESSLSVSPPSSSSSEISSPIIPPLLKNPSVKLEVPEKKAVISLPTTEQNQQQRPNRCTTCRKRVGLTGFKCRFGTMFCGVHRYPEIHGCSYDFKSAGREEIAKANPLVKAAKLQKI

SEQ ID NO: 837 - DNA, 1068 bp, Sorghum bicolor
  misc_feature: Ceres Annot ID no. 8656795
  misc_feature: Encodes the peptide sequence at SEQ ID NO. 840
atgacgaagcacaccgccttcgccgcggacgacgcgatcaccgccgccgccgtcacgtcgcagcccggccgccggttcacgtcgtacccgccgccgacgagggcgcgcggcggatgcagggtggccgcggcggcggcggcggcgcgccaggccacggaccccggcgccgtggtcgtggccgtggggtccttgccggaactcgtgccgcgccacgccgacctcgacttcgagaactggatggagaagcacccgtcggcattggccgagttcgagtcggtgctggccgccgccaaggggaagcagatcgtgatgttccttgactacgacggcaccctgtcgccgatcgttaaggaccccgacagcgccgtcatgtccgaggagatgcgagacgcggtgagaggcgtggccgagcacttcccgacggcgatcgtgagcgggaggtgtagagacaaggtgttcaacttcgtgaagctggcggagctgtactacgccgggagccacggcatggacatcaaggggcccacggcacagtccaagcacaccaaggcaaaggccgaagctgttctgtgccaaccagcgagcgcgttcctgccggtcattgacgaggtgtaccgcacgctgacggcgaggacagcgccgatccccggagcgacggtggagaacaacaagttctgcctctccgtccatttccgctgcgtccacgaggagaaatggcgcgctctggaggagcaggtccggtcggtgctcaaggagtacccggacctccggctcaccaagggcaggaaggtcttggagatccggccgtccatcgagtgggacaagggcaacgccctacagttcttgcttgagtccctcggtttcgctgacagtaacaatgtgttcccgatatatatcggagacgatcgcacggatgaggacgcgttcaaggtgctgcgcagcatgggccaagggatcggaatccttgtgagcaagattccaaaggagaccagtgcatcctactccttgcgtgaaccttctgaggtgaaggagttcctgcgcaagttggtgaggtccaagcagcgggactag

SEQ ID NO: 838 - DNA, 834 bp, Arabidopsis thaliana
  misc_feature: Ceres CLONE ID no.14203
  misc_feature: Encodes the peptide sequence at SEQ ID NO 839
aataaaaatacagattctctcttcttagaaccatcaccgattcgaacagatctaataaatcgtttttttcaccagatttttttcgccggagtttgttttgatccattctgttatggcggaagaacacagacttcaagaaccacgattatgtgctaacaattgtggcttcttcggaagcacagctacacaaaatctctgttccaaatgttttcgagatcttcaacatcaagaacaaaactcttccaccgccaaacatgctcttacccaatccttagccgccgttggcgctgctgcgtcttcctccgtgtcgccaccgcctccgcctccagctgattcgaaagaaatcgttgaagcgaaatcagagaaacgagcggcggctgaaccggaggaggcggatggtccgccgcaagatccgaagcggtgtttgacttgtcggcggcgcgtgggaatcacggggtttcggtgtaggtgtggtttcgttttctgcgggacgcataggtacgcggagcaacatgaatgttcgtttgatttcaagcggatggggaaggataagatcgctaaagcgaatccgattgtgaaagctgataagcttgagaagatttgactttgttgtttgttgtttgttgttgttgctttggttttgtgcgtttgaatgaaacacacatgaagaagaaagagcaagaaacaaacatgtcaatgtaaatttaagctttatttgatgatttcttcagtttggttattaaatttgcttattattgatttgattgttccgtttgatgatcttgtagaaggcttaagtcgtattatcaatgtgtagaatttggatttggttgg

SEQ ID NO: 839 - protein, 163 aa, Arabidopsis thaliana
  misc_feature: Ceres CLONE ID no.14203
  misc_feature: Bit score of 293.0 for HMM based on sequences of FIGURE 7.
  misc_feature (10)..(34): Pfam Name: zf-A20 Pfam Description: A20-like zinc finger
  misc_feature (104)..(144): Pfam Name: zf-AN1 Pfam Description: AN1-like Zinc finger
  misc_feature: Functional Homolog Of Ceres SEEDLINE ID no. ME04477 at SEQ ID NO. 742
MAEEHRLQEPRLCANNCGFFGSTATQNLCSKCFRDLQHQEQNSSTAKHALTQSLAAVGAAASSSVSPPPPPPADSKEIVEAKSEKRAAAEPEEADGPPQDPKRCLTCRRRVGITGFRCRCGFVFCGTHRYAEQHECSFDFKRMGKDKIAKANPIVKADKLEKI

SEQ ID NO: 840 - protein, 355 aa, Sorghum bicolor
  misc_feature: Ceres Annot ID no. 8656795
  misc_feature (1)..(355): Bit score of 573.1 for hmm based on sequences of FIGURE 9.
  misc_feature (105)..(339): Pfam Name: Trehalose_PPase Pfam Description: Trehalose-phosphatase
  misc_feature: Functional Homolog Of SEQ ID NO. 1129
MTKHTAFAADDAITAAAVTSQPGRRFTSYPPPTRARGGCRVAAAAAAARQATDPGAVVVAVGSLPELVPRHADLDFENWMEKHPSALAEFESVLAAAKGKQIVMFLDYDGTLSPIVKDPDSAVMSEEMRDAVRGVAEHFPTAIVSGRCRDKVFNFVKLAELYYAGSHGMDIKGPTAQSKHTKAKAEAVLCQPASAFLPVIDEVYRTLTARTAPIPGATVENNKFCLSVHFRCVHEEKWRALEEQVRSVLKEYPDLRLTKGRKVLEIRPSIEWDKGNALQFLLESLGFADSNNVFPIYIGDDRTDEDAFKVLRSMGQGIGILVSKIPKETSASYSLREPSEVKEFLRKLVRSKQRD

SEQ ID NO: 841 - protein, 411 aa, Vitis vinifera
  misc_feature: Public GI ID no. 157351695
  misc_feature (1)..(411): Bit score of 957.8 for hmm based on sequences of FIGURE 9.
  misc_feature (123)..(367): Pfam Name: Trehalose_PPase Pfam Description: Trehalose-phosphatase
  misc_feature: Functional Homolog Of SEQ ID NO. 1129
MDLKSNHSSPVLTDPPPVNKSRFGIRSNLLPYSPPGAAFSSTLFLTIPRKKNGVLDDVRSSSWLDAMKSSSPTHKKITKDFNTVLASTDTDVTYRTWLLKYPSALKSFEQITNYAKGKRIALFLDYDGTLSPIVDNPDRAFMSDCMRATVRNVAKFFPTAIISGRSRDKVYNFVGLTELYYAGSHGMDIMGPVRHSISNDHPNCIRLTDKQGKEVNLFQPASEFLPMIDEVFRSLVRCTKEIKGAEVENNKFCVSVHYRNVDEKYWKTIAQCVDDILKDYPRLRLTHGRKVLEVRPVIDWDKGKAVEFLLESLGLNNSDDVLPIYVGDDRTDEDAFKFLRDGKRGYGILVSSVPKESNAFYSLRDPLEVMEFLKLLVMWKKSNITLSNLIFNLMNLSNLLNPNLTHTFFYI

SEQ ID NO: 842 - protein, 376 aa, Populus balsamifera subsp. trichocarpa
  misc_feature: Ceres ANNOT ID no.1447260
  misc_feature: Bit score of 798.2 for HMM based on sequences of FIGURE 9.
  misc_feature (112)..(348): Pfam Name: Trehalose_PPase Pfam Description: Trehalose-phosphatase
  misc_feature: Functional Homolog Of Ceres SEEDLINE ID no. ME20095 at SEQ ID NO. 1129
MDVESNHSSPVLADPASINSSRLGIYSNLLPYSPPGGSLSSSKYSRKKPGKLDEVCSSGWLDAMKSSSPPRKKLFKDGSDTAYSSWMFKHPSALNSFEEIANFAKNKKIAMFLDYDGTLSPIVDDPDNAFMSDDMRSIVKNVAKYFPTAIISGRSRDKVYQLVGLTELYYAGSHGMDILGPVGKASMSNDHPNYSESTTDQQGKEVNLFQPAREFIPMIDEVFRTLVENTKGIEGAKVENHKFCASVHFRNVDEEDILDKYPRLRRTHGRKVLEVRPMIDWNKGKAVEFLLESLGLSNRDDVLSIYIGDDLSDEDAFKVLREGNRGYGILVSSRPKETSAVYSLKDPIEVMKFLNSLVTWKKVEEGGCILNNRRTI

SEQ ID NO: 843 - protein, 383 aa, Vitis vinifera
  misc_feature: Public GI ID no. 157360731
  misc_feature (1)..(383): Bit score of 892.1 for hmm based on sequences of FIGURE 9.
  misc_feature (113)..(357): Pfam Name: Trehalose_PPase Pfam Description: Trehalose-phosphatase
  misc_feature: Functional Homolog Of SEQ ID NO. 1129
MDLKSNHASPVLTDPAPVNKSRLGIPSGFSSGKYVIIPRKKPGKLDDVRSNGWLDAMKSSSPPRKKLIKDFNVEVATDDTDNVTSSWMLKYPSALNSFEKIISYAKSKKIAMFLDYDGTLSPIVDDPDRALMSDAMRSTVKNLAKYFPTAIISGRSRDKVYELVGLKELYYAGSHGMDIMGPARYTACNDHSNCIKSSDDQGKKVNLFQPASEFLPMIDEVFRALVETTRGIEGAKVENHKFCASVHYRNVDENSWSTIAQYVHDVLKDYPRLRLTHGRKVLEVRPVIDWNKGKAVEFLLESLGLTNSEDVLPIYIGDDRTDEDAFKVLREGNRGYGILVSPVPKETKAFYSLKDPAEVMEFLNSLVRWKELDAPINSEGRGA

SEQ ID NO: 844 - protein, 373 aa, Populus balsamifera subsp. trichocarpa
  misc_feature: Public GI ID no. 118484760
  misc_feature (1)..(373): Bit score of 691.7 for hmm based on sequences of FIGURE 9.
  misc_feature (117)..(350): Pfam Name: Trehalose_PPase Pfam Description: Trehalose-phosphatase
  misc_feature: Functional Homolog Of SEQ ID NO. 1129
MTNQNVVVADTNSGINLAITVHVTNSSIFTTAAQKPPAAPGGYISISRKKLLKNLEISGGARFNAWVNSMRTSSPTHVKSTPSANDDQSSWILHHPSALEMFEQIIDASKGKQIVMFLDYDGTLSPIVDDPDRAFMSKKMRATVRKLARFFPTAIVSGRCRDKVYNFVRLAELYYAGSHGMDIKGPAKGSKYKKGSEGVVFQAGSEFLPMIDEVYKELVEKTKTTPGAKVENNKFCLSVHYRCVDEKKWSGLAQVVKSVLKEYPKLRLTQGRKVLEIRPTIKWDKGKALEFLLESLGFANCTDVFPVYIGDDRTDEDAFKVLRERGQGFGILVSKFPKDTSASYSLQEPTQVMDFLQRLVQWKRLAFQGQSRV

SEQ ID NO: 845 - protein, 378 aa, Vitis vinifera
  misc_feature: Public GI ID no. 157328467
  misc_feature (1)..(378): Bit score of 663.2 for hmm based on sequences of FIGURE 9.
  misc_feature (110)..(343): Pfam Name: Trehalose_PPase Pfam Description: Trehalose-phosphatase
  misc_feature: Functional Homolog Of SEQ ID NO. 1129
MTRQNVVVADSKSGINVAITMTVSNSSLFTKAVQKTRETQGGCINIPPKKVGGGARINAWVDSMRASSPTRVKSAASLSDQNSWMLRHPSALNMFEQIIEASKGKQIVMFLDYDGTLSPIVDDPDRAFMSDAMRAAVRQLARYFPTAIVSGRCRDKVYNFVRLAELYYAGSHGMDIKGPAKGSKYKKETKAVLFQPASEFLPMIDEVYKALLEKTKSIPGASVEHNKFCLSVHYRCVDEKKWSILAQQVRSVLQQYPKLRLTQGRKVLEIRPTIKWDKGKALEFLLESLGFGNCTDVFPVYIGDDRTDEDAFKILRDRGQGFGILVSKIPKDTSASYSLQEPLEARTLSYYIHALILFLYLLSHLLVLIIIFFFLINL

SEQ ID NO: 846 - protein, 158 aa, Brassica napus
  misc_feature: Ceres CLONE ID no.975913
  misc_feature: Bit score of 372.3 for HMM based on sequences of FIGURE 7.
  misc_feature (104)..(144): Pfam Name: zf-AN1 Pfam Description: AN1-like Zinc finger
  misc_feature (13)..(37): Pfam Name: zf-A20 Pfam Description: A20-like zinc finger
  misc_feature: Functional Homolog Of Ceres SEEDLINE ID no. ME04477 at SEQ ID NO. 742
MAEEHRCQTPEGHRLCANNCGFLGSSATMNLCSNCYGDLCLKQQQQGSSSLSAVSPPPPVITSISTPMIQPLVQNPSAELEVPAKNVSVTVTATEQPQKRPNRCTTCRKRVGLTGFKCRCGTTFCGAHRYPEVHGCTFDFKSAGREEIAKANPLVKAA

SEQ ID NO: 847 - DNA, 961 bp, Brassica napus
  misc_feature: Ceres CLONE ID no.967417
  misc_feature: Encodes the peptide sequence at SEQ ID NO 848
gtacaaatattcgatttttcagcagcgtcgtctctgtttccatcttctttctctttcttctcccttcccgatttcatcgttaattggtaaagaaaaaaagtcagtgaatcatctctcttcttcttcttcttctctcaagaacaggttttcggtttaaagcctcgaaattctctatggcggaagagcatcgatgtcagacgccggaaggccaccgtctctgtgctaacaactgcggcttcctcggcagctccgccaccatgaatctatgctccaactgctacggcgatctctgccttaagcaacagcaagcttccatgaaatccaccgtcgaatcctctctctccgccgtatctcctccgtcgtcagagatcggttctatgcaatccaccgttgaatcctctctctccgacgtatctcctccatcatcggagaccatttccatctcttctccaatgatccagcctctcgttcgaaacccatcagctgaactggaggtaacggcgaagaacgttccgaagacggtgactccgccgccggagcagcagcagaaacggccgaatcggtgcacgacgtgtaggaaacgggtcgggttgactgggttcaagtgccggtgcggaacgactttttgcggggctcacaggtacccggaggtccatggatgcmccttcgatttcaaatcggccggtcgcgaagagatcgccaaggcgaacccactcgtcaaagcggcgaagcttcagaagatttgatcgccgccgttcgatgcgttgacttttaaaccatcatttgaacgcgtttgtctcccccagaaatggtgttagattgatctcagccgttcatgatgtgtcattatgtaaaagatatgtactacgaaggacacgtgtcacgtgacgttttcctcatcttcccaattaattttcttttccccttaaagaaataagattattcgcgttggcttttctct

SEQ ID NO: 848 - protein, 190 aa, Brassica napus
  misc_feature: Ceres CLONE ID no.967417
  misc_feature: Bit score of 348.9 for HMM based on sequences of FIGURE 7.
  misc_feature (13)..(37): Pfam Name: zf-A20 Pfam Description: A20-like zinc finger
  misc_feature (131)..(171): Pfam Name: zf-AN1 Pfam Description: AN1-like Zinc finger
  misc_feature: Functional Homolog Of Ceres SEEDLINE ID no. ME04477 at SEQ ID NO. 742
  misc_feature (164)..(164): Xaa is any aa, unknown, or other
MAEEHRCQTPEGHRLCANNCGFLGSSATMNLCSNCYGDLCLKQQQASMKSTVESSLSAVSPPSSEIGSMQSTVESSLSDVSPPSSETISISSPMIQPLVRNPSAELEVTAKNVPKTVTPPPEQQQKRPNRCTTCRKRVGLTGFKCRCGTTFCGAHRYPEVHGCXFDFKSAGREEIAKANPLVKAAKLQKI

SEQ ID NO: 849 - protein, 403 aa, Physcomitrella patens subsp. patens
  misc_feature: Public GI ID no. 168011492
  misc_feature (1)..(403): Bit score of 596.6 for hmm based on sequences of FIGURE 9.
  misc_feature (128)..(371): Pfam Name: Trehalose_PPase Pfam Description: Trehalose-phosphatase
  misc_feature: Functional Homolog Of SEQ ID NO. 1129
MALRSKRSALCAEPPTSSCGPSLSVASVIPTSPSKSSVLSASSGCSMPIPIVLPKKHNSFPGRGSVHTWIDGMRAQSPPPIRSLPGDTPELFDLEAAIYKSWLEDHPSALSSFDRVIKQSHNKQIVVFLDYDGTLSPIVEDPERAFMSAEMRATVKEVASCFPTAVISGRSRPKVYDFVRLSELYYAGSHGMDIQGPSNISDGFRVKGTKSRDKKGNDATNFQPASEFLPLINKVTTALIENTKMVKGAKVENNKFCVSVHFRRVKEELWEGLAERVGNVMKEFPTLSLTHGRKVLEVRPSIEWDKGKAVEFLLKSLGFQDTNDLIPLYLGDDKTDEDAFKVVNSTKYGCSILVSSVAKPTEAKFSLRDPSEVMGFLCKLVHWEKCRQDPNSIYMDRNFSQIP

SEQ ID NO: 850 - protein, 384 aa, Zea mays
  misc_feature: Public GI ID no. 194700086
  misc_feature (1)..(384): Bit score of 559.1 for hmm based on sequences of FIGURE 9.
  misc_feature (125)..(355): Pfam Name: Trehalose_PPase Pfam Description: Trehalose-phosphatase
  misc_feature: Functional Homolog Of SEQ ID NO. 1129
MTNQDVVVPDMGIAAAAALPPPGLFACRGVAGAVSSLRGTYGSLGLPGGAAADGGEFRSPVAAAANAPPGRTSCTSRVVEAIRASSPARCPAVDEYDAWTRKHPSALGSFDQIAAAAKGKRVVMFMDYDGTLSPIVADPDMAFMTPEMRAAVRNVAKRFPTAIVTGRCIEKVCSFVGLPELYYAGSHGMDIKGPNSKEDKTVLLLQPAREFLPVIDKAYKALVEKTKDTTGARVENNKFCLSVHFRCVDEKSWSSLAEKVKAVLRDFPELELTEGRKVVEVRPSIMWDKGKAVEFLLRSLGFDDDRTNVLPVYIGDDRTDEDAFKVLRERGQGIGILVSKCPKETDATYSLQDPTEVMEFLVRLGQWNPLRSPSPAARPRGRKQ

SEQ ID NO: 851 - protein, 364 aa, Zea mays
  misc_feature: Public GI ID no. 194702184
  misc_feature (1)..(364): Bit score of 557.6 for hmm based on sequences of FIGURE 9.
  misc_feature (104)..(348): Pfam Name: Trehalose_PPase Pfam Description: Trehalose-phosphatase
  misc_feature: Functional Homolog Of SEQ ID NO. 1129
MTKHGVVIGPEDVAAARHFSFPPPRTAAGGESCRKLAAQVDLGPAVVGSWLDSMKASSPRHRLMAPVPGAADAEHDDWMERHPSALDRFDALAAAAKGKQVAVFLDYDGTLSPIVEDPDRAVMTDEMRDAVRGVAARFPTAIVSGRCRDKVFSFVRLAELYYAGSHGMDIRGPTADANHHHGNGKAEAEAEAVLCQPASEFLPVMQEVYAALVAKVERAIPGAKVEDNKFCLSVHFRCVEEACWAALFEQVRAVLRDHPGLRLTQGRKVLEVRPMIRWDKGKALEFLLHALGFAADADRDDVFPIYVGDDRTDEDAFRVLRARGHGAGILVSRFPKDTSASFTLRDPAEVKEFLRKLVGANDDS

SEQ ID NO: 852 - protein, 357 aa, Zea mays
  misc_feature: Public GI ID no. 194697614
  misc_feature (1)..(357): Bit score of 556.2 for hmm based on sequences of FIGURE 9.
  misc_feature (103)..(337): Pfam Name: Trehalose_PPase Pfam Description: Trehalose-phosphatase
  misc_feature: Functional Homolog Of SEQ ID NO. 1129
MTKRTAFAADDAIIAAAAAVTSQPGRRFTSYPPARARGGCRLAPAVAAAARQATDDPGAAGSWPELVVPRHADFDDWMEKHPSALAAFESVLAAAKGKKIVMFLDYDGTLSPIVRDPDSAVMSEEMRDAVRGVAEHFPTAIVSGRCRDKVFNFVKLAELYYAGSHGMDIKGPTAQSKHTKAKAGAVLCQPARAFLPVIEEVYRALTASTAPIPGATVENNKFCLSVHFRCVQEEKWRALEEQVRSVLKEYPDLRLTKGRKVLEIRPSIKWDKGNALQFLLESLGFAGSNSVFPIYIGDDSTDEDAFKVLRNLGQGIGILVSKIPKETRASYSLREPSEVEEFLRKLVSWSKESRQRD

SEQ ID NO: 853 - protein, 355 aa, Zea mays
  misc_feature: Public GI ID no. 194707094
  misc_feature (1)..(355): Bit score of 547.7 for hmm based on sequences of FIGURE 9.
  misc_feature (101)..(335): Pfam Name: Trehalose_PPase Pfam Description: Trehalose-phosphatase
  misc_feature: Functional Homolog Of SEQ ID NO. 1129
MTKHTAFAADDAIIAAAAAITSQPGRRFTSYPPARARGGCRLAPAAAARQATDDPGAAVSWPELVVPRHADFDDWMEKHPSALAAFESVLAAAKGKKIVMFLDYDGTLSPIVRDPDSAVMSEEMRDAVRGVAEHFPTAIVSGRCRDKVFNFVKLAELYYAGSHGMDIKGPTAQSKHTKAKAGAVLCQPARAFLPVIEEVYRALTASTAPIPGATVENNKFCLSVHFRCVQEEKWRALEEQVRSVLKEYPDLRLTKGRKVLEIRPSIKWDKGNALQFLLESLGFAGSNSVFPIYIGDDSTDEDAFKVLRNLGQGIGILVSKIPKETRASYSLREPSEVEEFLRKLVSWSKESRQRD

SEQ ID NO: 854 - protein, 388 aa, Chlamydomonas reinhardtii
  misc_feature: Public GI ID no. 159488731
  misc_feature (1)..(388): Bit score of 382.1 for hmm based on sequences of FIGURE 9.
  misc_feature (105)..(341): Pfam Name: Trehalose_PPase Pfam Description: Trehalose-phosphatase
  misc_feature: Functional Homolog Of SEQ ID NO. 1129
MWRSYSAAPQGSSPGTSLASLGPGSGVWGPSRASFEQFGDEDSNDGKGRHGGHGGHRAGHSRSPLGGDQSEKDEAYLKWQEKHPCVLAHFASFKAAVDGKRLAVFLDYDGTLTPIVSNPDEAVMSEEMRDVVRSVARAFPTAIISGRGREKVEAFVQLKELFYAGSHGMDIAGPRGGTNGCQVSGNEFVTAFQPAAHFRPLIDHIYTQLQERLKEVPGSSVEHNNFCVSAHFRNCPGEAWQDVISAVEELVAQHDDLRMTRGRKVVEVRPKVDWHKGTALSHLVDALGLAQEPDVVAIYVGDDHTDEDAFRTLEETRRGFGILVSTRAKPTRARYTVRDPACVKDFLSGIVEWSKSDSNGWRAKPCCNGWSMDGLAATGAGPEAPQQQ

SEQ ID NO: 855 - DNA, 1640 bp, Glycine max
  misc_feature: Ceres Clone ID no. 1644562
  misc_feature: Encodes the peptide sequence at SEQ ID NO. 856
cttcaaacctccgcgttttctagtgccttgttgctacttacaccctattgttgaaaagtcaatcccccacaaatccctttttccacatccaccccttctccatttccttccttcaaaacattgcttacccttctcttttttcccccaaagtttcgttcttttgtatcttctctcattcaaagtttgagtcttccgcatttggggtgccctgaattgccgtgcaagttcagatctgcttacagaattcatatttgaatcggtgaagattttgaaaatgatcgtgagaaaaggcatggggcgagcaaagtcactgcttttgctgcttatggtgcttttgttttcctttgccacttataatttggtagctatgatcatggaccataaggcagatgggttggagtctttgaatagaaaaatgatggtatcgggaaagactaattcaaagtttcatgttgccgtgaccgcaaccgatgccgcttacaatcaatggcaatgccggattatgtactattggtataagaaagtgaaggacatgcctggatcagatatggggaaattcacccgtattttgcattctggaaggtcagaccagctgatggatgagattcctacttttgtggttgatccacttcctgagggcttggataagggttatattgtcctaaatagaccatgggcttttgttcagtggctggagaaagcagatattgaggaagaatatattctgatggcagaacctgaccacatatttgtaaagcctttgcctaatttggctcagggaaccctgcccgcagcatttccatttttctatataaaaccagatcagaatgaaaaaataatcaggaaattctatcctgaggaaaacggtcctgttactgatgttgatccaattggcaattctcctgtaatcattaagaagtctttgatggaggaaatagcttccacatgggtaaatgtttcattgagaatgaaagatgatcaagagactgataaagcttttggatgggtgcttgaaatgtatgcttatgctgtggcatctgcattgcatggtgtaaagcataatcttcgcaaagactttatgcttcagccaccttgggacttaaatgttgagaataagtttatcatccactatacatatggatgtgactataatatgaagggggaactgacatatgggaagattggagaatggcgttttgacaagaggtcttatcttttgggtcctccacccaaaaacctgcccttaccgcctccaggagttcctgaaagtgtggtgcggcttgttaaaatggtcaatgaggctactgcaaacatacctgaatgggattcattaaacaaaagctgagggaatgatgataaaccataaagccagtgattttgagatgaggactacaaataccatatcaaaaatagattagtttaagcaaataggagttgtgataaatacaaatgatgcttgtgctttctatgaaaatagatttttttttcttttaatggccaggaaattcttttacattcaaacgtatacaagacctttacaatctattacactgttgtagttttgcaaactgattgttatcatattgcaaccaatggaatggcatcttatcccttttgttttcccccacctttggtggatg

SEQ ID NO: 856 - protein, 356 aa, Glycine max
  misc_feature: Ceres Clone ID no. 1644562
  misc_feature (1)..(356): Bit score of 820.2 for hmm based on sequences of FIGURE 2.
  misc_feature: Functional Homolog Of SEQ ID NO. 489
MIVRKGMGRAKSLLLLLMVLLFSFATYNLVAMIMDHKADGLESLNRKMMVSGKTNSKFHVAVTATDAAYNQWQCRIMYYWYKKVKDMPGSDMGKFTRILHSGRSDQLMDEIPTFVVDPLPEGLDKGYIVLNRPWAFVQWLEKADIEEEYILMAEPDHIFVKPLPNLAQGTLPAAFPFFYIKPDQNEKIIRKFYPEENGPVTDVDPIGNSPVIIKKSLMEEIASTWVNVSLRMKDDQETDKAFGWVLEMYAYAVASALHGVKHNLRKDFMLQPPWDLNVENKFIIHYTYGCDYNMKGELTYGKIGEWRFDKRSYLLGPPPKNLPLPPPGVPESVVRLVKMVNEATANIPEWDSLNKS

SEQ ID NO: 857 - protein, 175 aa, Brassica rapa
  misc_feature: Public GI ID no.119720772
  misc_feature: Bit score of 350.6 for HMM based on sequences of FIGURE 7.
  misc_feature (116)..(156): Pfam Name: zf-AN1 Pfam Description: AN1-like Zinc finger
  misc_feature (16)..(40): Pfam Name: zf-A20 Pfam Description: A20-like zinc finger
  misc_feature: Functional Homolog Of Ceres SEEDLINE ID no. ME04477 at SEQ ID NO. 742
MSSEQNNSTSFPPTEPKLCDNGCGFFGSPSNMNLCSKCYRSLRAEEDQTAVAKAAVEKSLKLPSCSLITAPAPKQPLETKPASVETVVIAETSSVPPVATGQDEGEPSKPARPNRCFSCNKKVGVMGFKCKCGSTFCGSHRYPEKHECSFDFKEVGRGAIAKANPVVKADKVQRI

SEQ ID NO: 858 - DNA, 1207 bp, Glycine max
  misc_feature: Ceres CLONE ID no.708446
  misc_feature: Encodes the peptide sequence at SEQ ID NO 859
tataaatcaggtactaactctttctccttctcccctcatcccaatacccctttatttttttcgttttttttttatggaaaaaaatattgtagcaatttcgtcgtagaaacaaaattcccctattttcggcacgccgttgttgaatttccaatctgtgattttttttcttcttctatttatacgtgataattccaaaaagcctaacgcgagagattcatcagcttttcaattattcctcgaattattttgaaggaatcatccaaactgcttgaaatattcatcatcaacaacctcacgctgttatagatattctctctctctctctccctctctctctctctcacacacacacacacacagatccagacatggccgaagaacaccgatgccaagctcccgaaggtcacagactctgctccaacaactgcggtttctttggtagccccgccaccatgaatctctgttccaaatgctacagagacatccgtttgaaggaagaagaacaagccaaaaccaaatccacaatcgaaaccgctctttcaggatcttcctccgccaccgtcaccgcaaccgccgtcgttgcctcctccgtggaatccccttcggcgccggttgaatccctccctcaaccaccggtgctgatttcgccggatatagccgcaccggttcaggcgaaccggtgcggcgcgtgtaggaagcgcgtggggttgacagggttcaagtgcaggtgcggaacaacgttttgtgggagccacaggtaccccgagaaacacgcgtgtggcttcgatttcaaggcggtggggagagaggagatagcacgggcgaatcccgtgatcaaaggcgagaagctacggaggatttaatctgcgccgttggatgatcgaagcgattagggtgagttgatcaggaccgttcgtcgtggaccgttgatacgaaccgatttcgagcgtgtaaataaaaaaatctattattatgacgacattgggaagggttgaataagtcatattttggtggctttggtttgtgtttgtgcattaaaagtggaaaaatgttaggtccacccacgttcggaaattgaggggtttagaattgaaatgaaatgtaaaaaagtttagtttgattatttttctacggcatttctatttttctagtgggtggcgcgtttgccagaaagggaaattatcgtcggcaaaaaaaaaaaaaaaaa

SEQ ID NO: 859 - protein, 164 aa, Glycine max
  misc_feature: Ceres CLONE ID no.708446
  misc_feature: Bit score of 384.2 for HMM based on sequences of FIGURE 7.
  misc_feature (105)..(145): Pfam Name: zf-AN1 Pfam Description: AN1-like Zinc finger
  misc_feature (13)..(37): Pfam Name: zf-A20 Pfam Description: A20-like zinc finger
  misc_feature: Functional Homolog Of Ceres SEEDLINE ID no. ME04477 at SEQ ID NO. 742
MAEEHRCQAPEGHRLCSNNCGFFGSPATMNLCSKCYRDIRLKEEEQAKTKSTIETALSGSSSATVTATAVVASSVESPSAPVESLPQPPVLISPDIAAPVQANRCGACRKRVGLTGFKCRCGTTFCGSHRYPEKHACGFDFKAVGREEIARANPVIKGEKLRRI

SEQ ID NO: 860 - DNA, 1131 bp, Populus balsamifera subsp. trichocarpa
  misc_feature: Ceres ANNOT ID no.1447260
  misc_feature: Encodes the peptide sequence at SEQ ID NO 842
atggatgtcgagtcaaatcattcttctcctgttctcgctgaccctgcatcgataaacagttcaaggctcggtatctattctaatctgttgccttactcaccaccaggaggatcactctcctctagcaagtatagtaggaaaaagccagggaagcttgacgaagtctgctcgagtggatggctggatgccatgaaatcttcatcaccccctcggaagaagctctttaaggatggttctgacaccgcttacagttcctggatgttcaagcatccatcagcactcaattcatttgaggaaattgcaaattttgctaaaaacaagaagatagcaatgtttctagactatgatgggactctttctccaattgtagatgacccggataatgcgtttatgtctgatgatatgcgttctattgtaaaaaacgttgcgaagtatttcccaacggcgattattagtggaagaagtcgtgacaaggtttatcagctggtaggactaacagaactatattatgctggtagtcatgggatggacattttgggccctgtaggaaaagcttcaatgtccaatgatcatccaaactatagtgaatctactactgaccaacagggcaaggaggtgaatctgttccagcctgctagagaatttatacctatgatcgatgaggtttttagaacccttgtcgagaatactaagggaatcgagggtgcaaaagtcgagaatcacaaattttgtgcctctgtgcatttccgaaatgtagatgaggaggatattctagataagtaccctcgtttgcggagaactcatggacggaaggttttagaggtccgtccaatgattgactggaataaagggaaggcagttgaattcctgcttgaatctctagggctaagtaacagagacgacgtgctctcaatttatatcggcgatgatctgtcagatgaggatgcgttcaaggtgctccgggaggggaatcgaggttatggaattctcgtatcatctagacccaaagaaaccagtgcagtttactctctcaaagatccaattgaggtgatgaaatttcttaactccttggtgacatggaagaaggtagaagaaggtggatgcatcctgaataacaggaggactatctga

SEQ ID NO: 861 - protein, 445 aa, Populus balsamifera subsp. trichocarpa
  misc_feature: Ceres ANNOT ID no.1469023
  misc_feature: Bit score of 931.2 for HMM based on sequences of FIGURE 9.
  misc_feature (125)..(369): Pfam Name: Trehalose_PPase Pfam Description: Trehalose-phosphatase
  misc_feature: Functional Homolog Of Ceres SEEDLINE ID no. ME20095 at SEQ ID NO. 1129
MDLKSNHNAPVLTDSAPLSKSRLRGYHHGLMLPYSPSGAPFSSNLLLSIPRRKTGVLDDVRSCGWLDAMKSSSPTHKKFAKDINHELSAPDPEVAYRTWLLKYPSALASFEQIANFAKGKRIALFLDYDGTLSPIVENPDNAFMSADMRSIVKEVAKYFPTAIISGRSRDKVYEFVGLTELYYAGSHGMDIMGPVRQSVSDDHRNCIKSTDKQGNEVNLFQPAREFLPMIDEVYSSLVRITEDIKGATVENNKFCVSVHYRNVDQDNWKSVGERVQDVIKKYPRLRLTHGRKVLEIRPAINWDKGKALEFLLESLDLSNCDDVLPIYVGDDRTDEDAFKVLRERNCGYGIFVSKSPKESNAYYSLRDPAELENSCLRWTGYPKPEKRWESKIFVVYDDVCVNRDKPLRLDCCQNPSYVARTSLAGVRCTALQVRGPRAVEVVILT

SEQ ID NO: 862 - DNA, 938 bp, Glycine max
  misc_feature: Ceres CLONE ID no.1614593
  misc_feature: Encodes the peptide sequence at SEQ ID NO 863
attctccgttaagattctttcttctttcctctttccactcttggtcttatcttcttcacaatcccacaaccactccttgttataaatcagatccaaacatggccgaagaacaccgatgccaagctcccgaaggtcacagactctgctccaacaactgcggcttcttcggtagccccgccacaatgaatctctgttccaaatgctacagagacatccgtttgaaggaagaagaacaagccaaaactaaatccacaatcgaaaccgctctttctggatcttcctccgccaccgtcgccgttgcctccgccgtggattctcttccggcgccggttgaatccctccctcaaccgtcggtggtgagttcgccagatgtggccgcaccggttcaggcgaaccggtgcggcgcgtgtaggaagcgcgtgggattgactgggtttaagtgcaggtgcggaaccacgttttgtgggactcaccggtaccccgagaaacacgcgtgtggcttcgatttcaaggcggtggggagagaggagatagcacgggcgaatcccgtgatcaaaggcgagaagctacggaggatttaatctgcaccgttgatatgatgatcgaagcgattagggtgagttgatcaggaccgtccgtcgtgggccgttgatacgaacctatttcgagcgtgtgtaagaaaaaaaaaatctattagttatgacgacattgggaagggttgaataagtcatattttggaggctttgctttgtgtttgttcattaaaaatggaaaatgttaggtccacccacgttcggaaattgaggggtttgtttagaattgcaatgcaatgtaaaaaagtgtagtttaatatttttctacaggcatttctatttttcttccgtttgcgagaaaggtaaattatcgtctgcgttgtattcaaaaaaaaaaaaaaaaaa

SEQ ID NO: 863 - protein, 160 aa, Glycine max
  misc_feature: Ceres CLONE ID no.1614593
  misc_feature: Bit score of 375.5 for HMM based on sequences of FIGURE 7.
  misc_feature (101)..(141): Pfam Name: zf-AN1 Pfam Description: AN1-like Zinc finger
  misc_feature (13)..(37): Pfam Name: zf-A20 Pfam Description: A20-like zinc finger
  misc_feature: Functional Homolog Of Ceres SEEDLINE ID no. ME04477 at SEQ ID NO. 742
MAEEHRCQAPEGHRLCSNNCGFFGSPATMNLCSKCYRDIRLKEEEQAKTKSTIETALSGSSSATVAVASAVDSLPAPVESLPQPSVVSSPDVAAPVQANRCGACRKRVGLTGFKCRCGTTFCGTHRYPEKHACGFDFKAVGREEIARANPVIKGEKLRRI

SEQ ID NO: 864 - DNA, 1164 bp, Populus balsamifera subsp. trichocarpa
  misc_feature: Ceres ANNOT ID no.1474186
  misc_feature: Encodes the peptide sequence at SEQ ID NO 865
atggacctcaaatcaaatcacagtgctcctgtgctcactgattctgcacccctaggcaagtcaagactaggtgggcatcatggtttgttcccatgctcaccctcaggcggtgcagctttttcgccgaatctatggttatctattcctaagaagaaaactggagttcttgatgatgttcgctccattggttggctggacgcaatgaaatcatcatctcctcctcacaagaagtttaacaaggatattaacatggagctttcctcgcctgatccggaagctgcctaccgcacttggcttcttaaatatccatctgctcttgcatcttttgagcaaattgcaaactttgcaaaaggcaagagaatcgccttgttcctggattatgatggtactctatcgccgattgtagaaaatcccgacaatgccctcatgtctgatgttatgcgttctgctgtaaagaaagtggcaaaatatttccccacagcaataattagtggaagaagccgtgacaaggtatacgagtttgtaggactcacagaactctattatgcgggtagccatggaatggatattgtgggccctgttaggcactccacatctgatgatcacccaaattgtatcgagtctacggacatgcagggaaatgaagttaatttattccagccagctagagaatttttacctatgatcgacgaggtttttagctcccttctcaagagtaccgaagaaattaaaggtgcaacagttgagaacaataaattctgtgtctctgtacattaccgaaatgttgatgaagataaatggaaagcagtttgggagtgtgtcgaagatgtcattaagaagtaccctcgcctgcgattgacttttgggaggaaggttttagaaattcgtcccacgatcaattgggacaaggggaaagctcttgtgtttctacttgaatcactaggtctcagcaattgtgatgatgtgctccctatttatgttggagatgaccggacagatgaagatgcatttaagattttgagagagaggaactgtggttatgggattctggtatcaaaatcacccaaggaaagcaatgcatattactctctcagggacccatccgaggaaatactcgcaagtggttttgaagcagaggtgcaaagaagagaagacttccattag

SEQ ID NO: 865 - protein, 387 aa, Populus balsamifera subsp. trichocarpa
  misc_feature: Ceres ANNOT ID no.1474186
  misc_feature: Bit score of 896.9 for HMM based on sequences of FIGURE 9.
  misc_feature (124)..(368): Pfam Name: Trehalose_PPase Pfam Description: Trehalose-phosphatase
  misc_feature: Functional Homolog Of Ceres SEEDLINE ID no. ME20095 at SEQ ID NO. 1129
MDLKSNHSAPVLTDSAPLGKSRLGGHHGLFPCSPSGGAAFSPNLWLSIPKKKTGVLDDVRSIGWLDAMKSSSPPHKKFNKDINMELSSPDPEAAYRTWLLKYPSALASFEQIANFAKGKRIALFLDYDGTLSPIVENPDNALMSDVMRSAVKKVAKYFPTAIISGRSRDKVYEFVGLTELYYAGSHGMDIVGPVRHSTSDDHPNCIESTDMQGNEVNLFQPAREFLPMIDEVFSSLLKSTEEIKGATVENNKFCVSVHYRNVDEDKWKAVWECVEDVIKKYPRLRLTFGRKVLEIRPTINWDKGKALVFLLESLGLSNCDDVLPIYVGDDRTDEDAFKILRERNCGYGILVSKSPKESNAYYSLRDPSEEILASGFEAEVQRREDFH

SEQ ID NO: 866 - DNA, 1140 bp, Populus balsamifera subsp. trichocarpa
  misc_feature: Ceres ANNOT ID no.1527596
  misc_feature: Encodes the peptide sequence at SEQ ID NO 867
atggacctcaaatcaaatcacagtgctcctgtgctcactgattctgcacccctaggcaagtcaagactaggtgggcatcatggtttgttcccatgctcaccctcaggcggtgcagctttttcgccgaatctatggttatctattcctaagaagaaaactggagttcttgatgatgttcgctccattggttggctggacgcaatgaaatcatcatctcctcctcacaagaagtttaacaaggatattaacatggagctttcctcgcctgatccggaagctgcctaccgcacttggcttcttaaatatccatctgctcttgcatcttttgagcaaattgcaaactttgcaaaaggcaagagaatcgccttgttcctggattatgatggtactctatcgccgattgtagaaaatcccgacaatgccctcatgtctgatgttatgcgttctgctgtaaagaaagtggcaaaatatttccccacagcaataattagtggaagaagccgtgacaaggtatacgagtttgtaggactcacagaactctattatgcgggtagccatggaatggatattgtgggccctgttaggcactccacatctgatgatcacccaaattgtatcgagtctacggacatgcagggaaatgaagttaatttattccagccagctagagaatttttacctatgatcgacgaggtttttagctcccttctcaagagtaccgaagaaattaaaggtgcaacagttgagaacaataaattctgtgtctctgtacattaccgaaatgttgatgaagataaatggaaagcagtttgggagtgtgtcgaagatgtcattaagaagtaccctcgcctgcgattgacttttgggaggaaggttttagaaattcgtcccacgatcaattgggacaaggggaaagctcttgtgtttctacttgaatcactaggtctcagcaattgtgatgatgtgctccctatttatgttggagatgaccggacagatgaagatgcatttaagattttgagagagaggaactgtggttatgggattctggtatcaaaatcacccaaggaaagcaatgcatattactctctcagggacccatccgaggtacaatttatttttattcgaattactttttaa

SEQ ID NO: 867 - protein, 379 aa, Populus balsamifera subsp. trichocarpa
  misc_feature: Ceres ANNOT ID no.1527596
  misc_feature: Bit score of 894.7 for HMM based on sequences of FIGURE 9.
  misc_feature (124)..(368): Pfam Name: Trehalose_PPase Pfam Description: Trehalose-phosphatase
  misc_feature: Functional Homolog Of Ceres SEEDLINE ID no. ME20095 at SEQ ID NO. 1129
MDLKSNHSAPVLTDSAPLGKSRLGGHHGLFPCSPSGGAAFSPNLWLSIPKKKTGVLDDVRSIGWLDAMKSSSPPHKKFNKDINMELSSPDPEAAYRTWLLKYPSALASFEQIANFAKGKRIALFLDYDGTLSPIVENPDNALMSDVMRSAVKKVAKYFPTAIISGRSRDKVYEFVGLTELYYAGSHGMDIVGPVRHSTSDDHPNCIESTDMQGNEVNLFQPAREFLPMIDEVFSSLLKSTEEIKGATVENNKFCVSVHYRNVDEDKWKAVWECVEDVIKKYPRLRLTFGRKVLEIRPTINWDKGKALVFLLESLGLSNCDDVLPIYVGDDRTDEDAFKILRERNCGYGILVSKSPKESNAYYSLRDPSEVQFIFIRITF

SEQ ID NO: 868 - DNA, 1059 bp, Sorghum bicolor
  misc_feature: Ceres Annot ID no. 8732274
  misc_feature: Encodes the peptide sequence at SEQ ID NO. 869
atgagcgggaggaagaatgcgggcaaggtttccccctggttgctcggcctcatctctttaggatgcttctttgtgacctacaacctcctgacgatgcacggccggggacgggatgggccgcgcaagttcctcggcggcggcgaggatcacgactcaacgggctccggttcggaccccgcgaagcggttccacgtcgcgcttacggcgacggacgcactgtacagtcagtggcagtcgcggataatgcactactggtacaaggagatgagggaccgacctggctctgacatgggtggcttcactaggatccttcactcggggaagcctgatggattgatggatgagatacccaccatggtggttgacccccttcctgaaggcaaggataagggatatattgtcttaaataggccttgggcgtttgtccagtggatccagagagcaaagatcgtagaagattatatactaatggcagagccagatcatgtctttgtgaagcctttgccaaacttagcgcatggtgatgaaccggcagcatttccgtttttctacatcaaaccaactgataatgagaagatattgaggaaattttttccagaagaaaaagggcctgtttcaaatattgatcctattggcaactctccagttataatcaagaaggctcagcttgagaagattgctccaacctggatgaatgtttcattaaaaatgaaagaggatcaggagacagacaaagcatttggatgggtcttggaaatgtatgcatatgcagttgctagtgcactgcatggtgtgcgccatagtctccgtaaagattttatgattcagcctccatgggacctgaaaacggacaacacattcatcatccattatacatatggatgcgattattcaatgaagggtcagctaacttatgggaaaatcggtgaatggcgttttgacaaaagatcttaccttcaatcaccaccaccaagaaatctttctctgccccctccaggagttcctgaaagtgtgattccccgtcacatcgaatctttagacgcatgcatggaatattaa

SEQ ID NO: 869 - protein, 352 aa, Sorghum bicolor
  misc_feature: Ceres Annot ID no. 8732274
  misc_feature (1)..(352): Bit score of 811.3 for hmm based on sequences of FIGURE 2.
  misc_feature: Functional Homolog Of SEQ ID NO. 489
MSGRKNAGKVSPWLLGLISLGCFFVTYNLLTMHGRGRDGPRKFLGGGEDHDSTGSGSDPAKRFHVALTATDALYSQWQSRIMHYWYKEMRDRPGSDMGGFTRILHSGKPDGLMDEIPTMVVDPLPEGKDKGYIVLNRPWAFVQWIQRAKIVEDYILMAEPDHVFVKPLPNLAHGDEPAAFPFFYIKPTDNEKILRKFFPEEKGPVSNIDPIGNSPVIIKKAQLEKIAPTWMNVSLKMKEDQETDKAFGWVLEMYAYAVASALHGVRHSLRKDFMIQPPWDLKTDNTFIIHYTYGCDYSMKGQLTYGKIGEWRFDKRSYLQSPPPRNLSLPPPGVPESVIPRHIESLDACMEY

SEQ ID NO: 870 - protein, 375 aa, Zea mays
  misc_feature: Public GI ID no. 194692712
  misc_feature (1)..(375): Bit score of 910.8 for hmm based on sequences of FIGURE 2.
  misc_feature: Functional Homolog Of SEQ ID NO. 489
MDAAVRKAAGAGIARAPALVLALVAAGAFLISYNFFTMLFHGGGGIGAAVTAGTRDPVVAMPAWMRAAADTEARRRPFHVALTATDAPYSRWQCRVMYFWYKRMQARPGGEAMGGFTRVLHSGKPDGLMDEIPTFVVDPLPAGKDHGYVVLNRPWAFVQWLQKAKIEEEYILMAEPDHIFVKPLPNLAHDDDPAAFPFFYITPSEHEKIIRKYYAKERGPVTDIDPIGNSPVIIKKTILEKIAPTWMNVSIQMKEDEETDKVFGWVLEMYAYAVASALHGVHHILRKDFMIQPPFDTKLQNTFIIHFTYGCDYSLKGELTYGKVGEWRFDKRSFPDRPPPRNLTLPPPGVPESVVTLVKMVNEASANLPRWDDGI

SEQ ID NO: 871 - protein, 360 aa, Vitis vinifera
  misc_feature: Public GI ID no. 157346787
  misc_feature (1)..(360): Bit score of 876.5 for hmm based on sequences of FIGURE 2.
  misc_feature: Functional Homolog Of SEQ ID NO. 489
MIVRKSMGRASLLLLVLLALGFFFATYNLLTMIMHNRGSDDFDVFDPITRMTKETKKVGNRNLYFHVALTATDAPYSQWQCRIMYYWYKKVKDMPGSEMGGFTRVLHSGSPDSLMDEIPTFVVYPLPDGLDRGYIVLNRPWAFVQWLEKATIEEEYILMAEPDHIFVNPLPNLAHGGHPAGFPFFYIKPADNEKIIRKFYPKEKGPVTDVDPIGNSPVIIEKSQLEEIAPTWMNISLRMKDDPETDKAFGWVLEMYAYAVASALHGVQHILRKDFMLQPPWDLEVGKKFIIHYTYGCDYNLKGELTYGKIGEWRFDKRSFLSGPPPKNLTLPPPGVPESVVRLVQMVNEATANIPGWDVE

SEQ ID NO: 872 - protein, 310 aa, Vitis vinifera
  misc_feature: Public GI ID no. 157351855
  misc_feature (1)..(310): Bit score of 781.6 for hmm based on sequences of FIGURE 2.
  misc_feature: Functional Homolog Of SEQ ID NO. 489
MPENVRKPKNAKLPFHIALTATDAPYSKWQCRIMYYWYKKKKDLPGSEMGGFTRILHSGSPDNLMEEIPTFVVDPLPAGLDRGYIVLNRPWAFVQWLEKATIEEEYILMAEPDHIFIKPLPNLAHGDYPAAYPFFYIKPVQNEKIIRKFYPEEHGPVTNVDPIGNSPVIIKRELLEKIAPTWMNVSLRMKDDPETDKVFGWVLEMYAYAVASALHGVQHILQKDFMLQPPWDLETAKKFIIHYTYGCDYNLKGELTYGKIGEWRFDKRSYLRGPPPRNLSLPPPGVPESVVTLVKMVNEATANLPRWDTQ

SEQ ID NO: 873 - protein, 364 aa, Vitis vinifera
  misc_feature: Public GI ID no. 157339761
  misc_feature (1)..(364): Bit score of 745.1 for hmm based on sequences of FIGURE 2.
  misc_feature: Functional Homolog Of SEQ ID NO. 489
MGCGNFFYVLLITFSVALITYNILISANAPLKQGFPGHPSSSSTPFSVDPIIKMPTDRSNPSSTKGKRLFHTAVTASDSVYNTWQCRVMYYWFKKFKDGPNSEMGGFTRILHSGKPDKFMHEIPTFVAQPLPAGMDQGYIVLNRPWAFVQWLQQADIKEDYILMAEPDHIIVKPIPNLSRDGLGAAFPFFYIQPKQYESTLRKFYPEEKGPITNVDPIGNSPVIVGKESLKKIAPTWMNVSLAMKKDPEADKTFGWVLEMYAYAVASALHDVGNILFKDFMIQPPWDTEIGKKFIIHYTYGCDYNMQGELTYGKIGEWRFDKRSFDSKWPPRNLPLPPPGVPESVVTLVKMVNEATANIPNWGS

SEQ ID NO: 874 - protein, 351 aa, Physcomitrella patens subsp. patens
  misc_feature: Public GI ID no. 168039081
  misc_feature (1)..(351): Bit score of 756.4 for hmm based on sequences of FIGURE 2.
  misc_feature: Functional Homolog Of SEQ ID NO. 489
MVVTYNTITMINSYHNRSDLIDSRAGEEDDDNQFAFDPLIRMPKDMKRNGPKRLFHVAVTANDSPYNRWQCRIMYYWYKKFKDAPGSEMGGFTRILHSGKADNFMDEIPTVVVDPLPDGEDRGYIVLNRPWAFVQWLRKADIPEDYILMAEPDHIFIRPLPNLATEEMPAAFKFFYIVPTENEKVLRKFFPNEKGPIANIDPIGNSPVIIKKSQLEKIAPTWSDVSIKMKDDPETDKAFGWVLEMYGYATASALHGIRHMLVKDFMLQPPWDTDLGNKYIIHYTYGCDYNMQGKLTYGKIGEWRFDKRSFTTGAPPKNLTLPPPGVPETVVTLVKMVNEATASIPGWKGGE

SEQ ID NO: 875 - DNA, 1431 bp, Sorghum bicolor
  misc_feature: Ceres Annot ID no. 8733731
  misc_feature: Encodes the peptide sequence at SEQ ID NO. 876
atggagggttgcaactcgcacggcggtggcggcggcggaggaggaggaggaggaggaggagggtcgagctcgccgccgccgttcctcatcaagacctacgagatggtggaggacccggcgacgaaccacgtggtgtcgtggggacccggcggcgccagcttcgtggtgtggaacccgccggacttctcgcgggacctgctgcccaagtacttcaagcacaacaacttctccagcttcatcaggcagctcaacacatacggtttccgaaagatcgatccagagagatgggagtttgccaacgacgacttcatacggggacacacgcaccttctgaagaacatccaccggcgcaaaccggtgcacagccactcgctgcagacgcaggtgaacgggccattagcggagtccgagaggcgcgagcttgaggacgagatcaacaggctcaagtacgagaagagcctgctgctggcagatctccagaggcagaaccagcagcggtgcgggatcagctggcagatgcagtcgctggagagcaggctggtggcgatggaggagcgccagaggcacatcgtggcgtccctgtgtgacatcctgcagagacacggggttgttccgggctcgacgacgacgacgctggagatggagacgccggcggaccacttcagcaagaagaggagggtgccgaagttcggtttcttcgtcgacgccgacgaacccaaggtggaagaacagcaggtgccgtcgttcctgcagacggtgggaggagtagtagcagagacaccaggcatgtctccgatccgccttttgaatgatgagccgtttgagaagatggagctggccttggtgtcgctggagaatttcttccagagggcaacccattcgcctgctgccaatgacattgacatgtacgctggtggtgctgctgaaccacccagccctgctctgagtctcggggagatgttctcagtctcagcaccaatggataccagtatcaatctgcagtcatcagctcgccactgccagaatccctttgcttccacctcagggcaagaccagtcgtcatctccattggcacaagcagaacctccgagctacgacgcccggagcccgatcctgccattggcacagctccatgaatatgcccctagggcagctgaagtcgatatgaactctgacaccacaactggcgacacttcacaagatgagaccaccagtgaaactgaaggttcccatttgccggccaaggcgaacgatatattctgggagcagtttctcaaagacgaagagggtaaaatagaagcaaaggaagatgtgaagactgccgtagaccgcagctgtcgtcgtctacaggacaatgttgatcagatcactgagcagatggggcagctcgattcagctgagaacggctcttatgcaccccagacttactga

SEQ ID NO: 876 - protein, 476 aa, Sorghum bicolor
  misc_feature: Ceres Annot ID no. 8733731
  misc_feature (1)..(476): Bit score of 71.4 for hmm based on sequences of FIGURE 12.
  misc_feature (26)..(194): Pfam Name: HSF_DNA-bind Pfam Description: HSF-type DNA-binding
  misc_feature: Functional Homolog Of SEQ ID NO. 311
MEGCNSHGGGGGGGGGGGGGGSSSPPPFLIKTYEMVEDPATNHVVSWGPGGASFVVWNPPDFSRDLLPKYFKHNNFSSFIRQLNTYGFRKIDPERWEFANDDFIRGHTHLLKNIHRRKPVHSHSLQTQVNGPLAESERRELEDEINRLKYEKSLLLADLQRQNQQRCGISWQMQSLESRLVAMEERQRHIVASLCDILQRHGVVPGSTTTTLEMETPADHFSKKRRVPKFGFFVDADEPKVEEQQVPSFLQTVGGVVAETPGMSPIRLLNDEPFEKMELALVSLENFFQRATHSPAANDIDMYAGGAAEPPSPALSLGEMFSVSAPMDTSINLQSSARHCQNPFASTSGQDQSSSPLAQAEPPSYDARSPILPLAQLHEYAPRAAEVDMNSDTTTGDTSQDETTSETEGSHLPAKANDIFWEQFLKDEEGKIEAKEDVKTAVDRSCRRLQDNVDQITEQMGQLDSAENGSYAPQTY

SEQ ID NO: 877 - DNA, 1167 bp, Solanum lycopersicum
  misc_feature: Ceres Annot ID no. 8458120
  misc_feature: Encodes the peptide sequence at SEQ ID NO. 878
atggataactgtaatggaggatcaagttcttcttctccggcgccttttttgttgaaaacttatgaactggttgatgattcgtatactaatccagttgtttcatggagccataacggacgtagcttcgttgtttggaatccacctgaattcgctagagatttgcttccgaaatactttaagcataacaatttctcaagttttatcagacaacttaatacttatgggtttagaaaggttgatcctgaacaatgggagtttgcgaacgaggattttttaagaggacgtagacatttgttgaagaatatttatagacgaaagccgatccatagccactctgctgcagcaggaacagggcaatctgtagctccattgacggattctgagagacaggagtatgaagatgaaatcgagaggttgaagagagaaaacagtcttcttcagtcgtctgcggagaatcaattgaaattcaatggggagtacgaaagtggaattaagtctatggagcaacgtttacagaacgttgctcatagacaggggaaattgatttctcttttagctcaattactacaaacacctggattttcatctgatttcactcaaagcgcgagcaggaagagacgattgttgatatcaaattacttgattgacgaggaaaactcaccaaaattcgacttggaaatggttaaaaagttggattcatcaatcaatttttgggagcggtttctgtatggtgttcaaacacaagatttcgagcatacacattccccaattgttacacatacatcatctaatgattctgccaaacgaaactctcccatcgatcattcaccatcctcctccgagttagggccattgaatcctgtcatgtcatcaacttatgaaaatttagaacgtcaacttaagccatctgataatcagattgagtgtaagaccagtaaaacatctgaattagtatcaaactcgggtaatgatgtattttggcaacagttcttaacagagacgcctggttgcactgagccacaacaagttgagaacaaagggataaacgaatcaacgcgtgatattagattaggggatagccatagatattggtggaatcgcggagttaatttagaaaatcttgctgaaagaatgggacatcttagtagtccagcaacaggaagctga

SEQ ID NO: 878 - protein, 388 aa, Solanum lycopersicum
  misc_feature: Ceres Annot ID no. 8458120
  misc_feature (1)..(388): Bit score of 64.1 for hmm based on sequences of FIGURE 12.
  misc_feature (13)..(185): Pfam Name: HSF_DNA-bind Pfam Description: HSF-type DNA-binding
  misc_feature: Functional Homolog Of SEQ ID NO. 311
MDNCNGGSSSSSPAPFLLKTYELVDDSYTNPVVSWSHNGRSFVVWNPPEFARDLLPKYFKHNNFSSFIRQLNTYGFRKVDPEQWEFANEDFLRGRRHLLKNIYRRKPIHSHSAAAGTGQSVAPLTDSERQEYEDEIERLKRENSLLQSSAENQLKFNGEYESGIKSMEQRLQNVAHRQGKLISLLAQLLQTPGFSSDFTQSASRKRRLLISNYLIDEENSPKFDLEMVKKLDSSINFWERFLYGVQTQDFEHTHSPIVTHTSSNDSAKRNSPIDHSPSSSELGPLNPVMSSTYENLERQLKPSDNQIECKTSKTSELVSNSGNDVFWQQFLTETPGCTEPQQVENKGINESTRDIRLGDSHRYWWNRGVNLENLAERMGHLSSPATGS

SEQ ID NO: 879 - DNA, 1963 bp, Panicum virgatum; identical to SEQ ID NO: 778
  misc_feature: Ceres Clone ID no. 1862704
  misc_feature: Encodes the peptide sequence at SEQ ID NO. 880

SEQ ID NO: 880 - protein, 521 aa, Panicum virgatum; identical to SEQ ID NO: 779
  misc_feature: Ceres Clone ID no. 1862704
  misc_feature (1)..(521): Bit score of 1110.0 for hmm based on sequences of FIGURE 12.
  misc_feature (51)..(226): Pfam Name: HSF_DNA-bind Pfam Description: HSF-type DNA-binding
  misc_feature: Functional Homolog Of SEQ ID NO. 311

SEQ ID NO: 881 - DNA, 1882 bp, Arabidopsis thaliana
  misc_feature: Ceres Clone ID no. 146737
  misc_feature: Encodes the peptide sequence at SEQ ID NO. 882
aacacttgagagagtctctgtctctgtaaaagatatttgagcttgagaagaacagaagaaacttccaggatcaatcaatcgatcaactttagtgaactaactcttgatttttcattcgaagttatggaatcggttcccgaatccgtaccatcgccgaactcgaatacaccgtcaataccaccgccggtgaactccgtaccgcctttcttgagtaaaacctacgacatggttgatgatccgttgaccaatgaggtcgtttcgtggagcagcgggaacaacagcttcgtcgtctggagtgtcccggagttctcgaaggtgctcttgcccaagtatttcaagcacaacaacttctccagcttcgtcagacagttaaatacttatggtttcagaaaagttgatcctgaccgatgggaatttgcaaatgaaggatttcttagaggccgaaaacaactactgaagagtattgtcaggagaaaaccttcgcatgtgcagcagaatcagcaacaaactcaagttcagagctcatctcttggtgcttgtgtcgaggtggggaagtttggaatagaagaagaagtggaaagacttaagcgggataagaatgttcttatgcaagaactcgtcaggttaaggcagcaacagcaagctactgaaaaccaactgcagaatgtgggacagaaagttcaggtgatggagcaaaggcaacaacaaatgatgtcgtttttagcaaaggctgttcaaagtccaggtttcttaaaccagttagtacaacagaataataatgatggcaacagacaaattccaggaagcaacaaaaagaggagacttcctgtagatgagcaggagaatcgtggcgacaatgtggctaatggtcttaaccgccagattgttagatatcagccgtcgataaacgaagcagcacaaaatatgcttcgacagttcttaaatactagtacctcacctcggtatgaatcagtttcaaacaatcctgacagtttcctattgggtgatgttcccagttctacctctgtagacaatgggaacccttcaagtagagtttctggagtaacattggccgagttttcacccaacacagttcagtcagcaacgaatcaagtacccgaagcaagtttggctcatcatcctcaagctggtctggttcagccaaatataggtcaaagtccggctcaaggagcagcacctgcagactcttggagccctgaatttgatttagttggatgcgagacagatagtggagagtgttttgatccaataatggctgttttagatgagtcagaaggcgatgcaatttctcctgaaggtgagggaaagatgaatgagttactggagggagtccctaagctgcccggaatccaagatccattctgggaacagttcttttctgttgaactcccagcgattgcagatacagacgagattctatcaggatcagtggagaataatgacttggtaatggaacaagaaccaaacgagtggacccgtaatgaacaacaaatgaagtatcttactgaacaaatgggactgctttcctcagaagcacagaggaaataaaggggaggttgcgaaaggagatatcaaggaaggaggaatatatcagatggtgtgtataccctttacatttttacttaaatgaagaaaaaaaacagagagaagaaacataaaagatttaccaccaagcttgtgaatagttagtagagatcggtttttgtgttgtttatattatacttttgtgtgaaaacgttcatcttgttcaattatcatctcagtagtacggtaatctgttggtcactgaccggttaatgaccaaaaaatcaagattattttcttatgtttatttcttttgatcatgaagatccttatgacg

SEQ ID NO: 882 - protein, 481 aa, Arabidopsis thaliana
  misc_feature: Ceres Clone ID no. 146737
  misc_feature (1)..(481): Bit score of 669.4 for hmm based on sequences of FIGURE 12.
  misc_feature (26)..(200): Pfam Name: HSF_DNA-bind Pfam Description: HSF-type DNA-binding
  misc_feature: Functional Homolog Of SEQ ID NO. 311
MESVPESVPSPNSNTPSIPPPVNSVPPFLSKTYDMVDDPLTNEVVSWSSGNNSFVVWSVPEFSKVLLPKYFKHNNFSSFVRQLNTYGFRKVDPDRWEFANEGFLRGRKQLLKSIVRRKPSHVQQNQQQTQVQSSSLGACVEVGKFGIEEEVERLKRDKNVLMQELVRLRQQQQATENQLQNVGQKVQVMEQRQQQMMSFLAKAVQSPGFLNQLVQQNNNDGNRQIPGSNKKRRLPVDEQENRGDNVANGLNRQIVRYQPSINEAAQNMLRQFLNTSTSPRYESVSNNPDSFLLGDVPSSTSVDNGNPSSRVSGVTLAEFSPNTVQSATNQVPEASLAHHPQAGLVQPNIGQSPAQGAAPADSWSPEFDLVGCETDSGECFDPIMAVLDESEGDAISPEGEGKMNELLEGVPKLPGIQDPFWEQFFSVELPAIADTDEILSGSVENNDLVMEQEPNEWTRNEQQMKYLTEQMGLLSSEAQRK

SEQ ID NO: 883 - DNA, 1619 bp, Zea mays; identical to SEQ ID NO: 788
  misc_feature: Ceres Clone ID no. 229513
  misc_feature: Encodes the peptide sequence at SEQ ID NO. 886

SEQ ID NO: 884 - DNA, 558 bp, Panicum virgatum
  misc_feature: Ceres CLONE ID no.1821214
  misc_feature: Encodes the peptide sequence at SEQ ID NO. 1189
  misc_feature (242)..(242): n is a, c, t, g, unknown, or other
  misc_feature (243)..(243): n is a, c, t, g, unknown, or other
  misc_feature (403)..(403): n is a, c, t, g, unknown, or other
  misc_feature (404)..(404): n is a, c, t, g, unknown, or other
  misc_feature (405)..(405): n is a, c, t, g, unknown, or other
aaacccatttccttcctgcctccaccttccagcccaggcccggcggtgcctctccctctcgtctccggatcggcaagagcccagctgctgccggattcacacgacacctcgtcgtctctctctctctctctctctctctctctctctctctctctctctctctctccggccatggcgcagcgcgacaagaaggtggaggagccgacggagctgcacgcgccggagctcacgctctgcgccgnnagctgcggcttcccgggcaacccggcgaccaacaacctctgccagaactgcttcgtggccgcctcggcctcagtgtcgcctttttttccctcctcctcctcctcggcgccctcgccggcagtgttcgacaagccgcggccggcagtcgcccctaccgccnnntggccgccgttccccgcggccgccgaccggcccccggcgggccccgcggagtccctctccgaggcgccccggacgtcgccgtcagtcacccggggccacagctgtcgaaagccggtcgggctgacagggtcccggggtcgctgccgcgagctc

SEQ ID NO: 885 - protein, 109 aa, Panicum virgatum
  misc_feature: Ceres CLONE ID no.2025938
  misc_feature: Bit score of 100.8 for HMM based on sequences of FIGURE 7.
  misc_feature (18)..(42): Pfam Name: zf-A20 Pfam Description: A20-like zinc finger
  misc_feature (98)..(109): Pfam Name: zf-AN1 Pfam Description: AN1-like zinc finger
  misc_feature: Functional Homolog Of Ceres SEEDLINE ID no. ME04477 at SEQ ID NO. 742
MAQRDKKEEPTELRAPEITLCANNCGFPGNPATQNLCQSCFSAATASMSSPTSSSSSPAPAPAAAPQPRPAPVELASPADAAVAAPAPEAARTPANRCSSCRKRVGLTG

SEQ ID NO: 886 - protein, 417 aa, Zea mays; identical to SEQ ID NO: 789
  misc_feature: Ceres Clone ID no. 229513
  misc_feature (1)..(417): Bit score of 142.9 for hmm based on sequences of FIGURE 12.
  misc_feature (49)..(226): Pfam Name: HSF_DNA-bind Pfam Description: HSF-type DNA-binding
  misc_feature: Functional Homolog Of SEQ ID NO. 311

SEQ ID NO: 887 - protein, 496 aa, Vitis vinifera; identical to SEQ ID NO: 753
  misc_feature: Public GI ID no. 157341912
  misc_feature (1)..(496): Bit score of 1165.6 for hmm based on sequences of FIGURE 12.
  misc_feature (33)..(209): Pfam Name: HSF_DNA-bind Pfam Description: HSF-type DNA-binding
  misc_feature: Functional Homolog Of SEQ ID NO. 311

SEQ ID NO: 888 - protein, 489 aa, Picea sitchensis
  misc_feature: Public GI ID no. 116787265
  misc_feature (1)..(489): Bit score of 361.3 for hmm based on sequences of FIGURE 12.
  misc_feature (65)..(244): Pfam Name: HSF_DNA-bind Pfam Description: HSF-type DNA-binding
  misc_feature: Functional Homolog Of SEQ ID NO. 311
MVECGVLMCVCVGVFCRSLIMDSQNSGISAGDEVNLGNFNVKEEESMQMPRCPRPMEGLHCAGPPPFLTKTYDMVEDPLTDTVVSWSSTNNSFVVWNSHLFSSDLLPKYFKHNNFSSFVRQLNTYGFRKVDPDRWEFANEGFLRGQKHLLKLIQRRKPSCPPQFIDNLHHHHQQDQQQGMGACVEVGQFGMVGEIEGLRRDKSVLMLEVVKLRQQQQSTRNQLQTIGHRLQSTEQRQQHMMTFLARAIQNPTFLAQLSQNKQASKRLATSKKRRRLPKGEAQQDLPSFPASEGRIVKYQSSTSTPADSDHTQNSSNLEAFLSTMGHVDSPDMPTPHKTFQDREQDESSSSISMIAEQLYGFEPGSAFDISMPVDIPIETASAFDRNSVNLVGAEGEEDLDLENVNDVFWEELLNEHFDSQDDSGTEAEANFPDQDKGNFSSSSRSDVNLLAEQMGLTAFHQSIPIIPEKLIALESGLVSHSNLKNPSYF

SEQ ID NO: 889 - protein, 442 aa, Vitis vinifera
  misc_feature: Public GI ID no. 157344554
  misc_feature (1)..(442): Bit score of 180.2 for hmm based on sequences of FIGURE 12.
  misc_feature (13)..(182): Pfam Name: HSF_DNA-bind Pfam Description: HSF-type DNA-binding
  misc_feature: Functional Homolog Of SEQ ID NO. 311
MEASQSTSSNSPPPFLTKTYEMVDDPITDSIVSWSQAGHSFVVWNPPEFAKDLLPKYFKHNNFSSFVRQLNTYGFRKADPEQWEFANEEFIRGQRHLLKNIHRRKPIHSHSTQNQVGSAPLPESEKQEFEAEIERLKHDKGALLSELQRYKQENQFFEFQTQSLGKRVFNMELRQRKMMAYLAQVLQKPGFTSSLMAQSEIHNKKRRLLMPNYLFNEANVEENMVVTFQKEKPDTISVQGENVEMIESLESSLNFWENFLYGIGQGSADVMDGFGTLSQPSPLIITEMHSSSDPDTSTQPCSPKSYPSSPHSRDIHSSPELARATNHADSPAISSIYLNIDGCPKSLRIDVNSEPTNASEVEASKECEGGTTAAGANDVFWAQFLTETPGSSDAQEVQSERRDAYGGKGDSKPDDHRKYWWDTNNLDHLTKKMGHLTSSERT

SEQ ID NO: 890 - protein, 407 aa, Zea mays; identical to SEQ ID NO: 768
  misc_feature: Public GI ID no. 194693220
  misc_feature (1)..(407): Bit score of 160.6 for hmm based on sequences of FIGURE 12.
  misc_feature (49)..(226): Pfam Name: HSF_DNA-bind Pfam Description: HSF-type DNA-binding
  misc_feature: Functional Homolog Of SEQ ID NO. 311

SEQ ID NO: 891 - protein, 415 aa, Vitis vinifera
  misc_feature: Public GI ID no. 157339031
  misc_feature (1)..(415): Bit score of 146.9 for hmm based on sequences of FIGURE 12.
  misc_feature (12)..(186): Pfam Name: HSF_DNA-bind Pfam Description: HSF-type DNA-binding
  misc_feature: Functional Homolog Of SEQ ID NO. 311
MVKSTEAGSVVPPFLKKCYEMVDDEASDAIISWNLSNDSFVIRDTTEFSHQLLPKYFKHNNFSSFMRQLNIYGFRKIDTDHWEFANEGFIRGQKHLLKNIRRRKQLQGQDKQKSSHQRDKSAGACEEIEASKLWNDVEILKTDRNALTQQLVKLRQHQETAESKLLVLRERLQGMEKNQQQMLSFLVMAMQSPEFLVQFMQPKEKNWRMAEVGKNMLERRAENGEPAASDVMIVRYQPPMDETPKPLPIPTSNSEKSLESDGMIVRYQPPMDETAKPLLMAKSNSEKSLESDFFMNIDFMKILMDGNMGSSEHQEPLILPDLPDDDILDQLLLENFADAKLDNQQAPIDSGMVMDPTVNQTQLDEPQHFELLNLEQKMPLKRMEKPYELEVESTLHGTRFEKSQHSELLTEQMGQ

SEQ ID NO: 892 - protein, 170 aa, Medicago truncatula
  misc_feature: Public GI ID no.92896423
  misc_feature: Bit score of 368.4 for HMM based on sequences of FIGURE 7.
  misc_feature (11)..(35): Pfam Name: zf-A20 Pfam Description: A20-like zinc finger
  misc_feature (111)..(151): Pfam Name: zf-AN1 Pfam Description: AN1-like Zinc finger
  misc_feature: Functional Homolog Of Ceres SEEDLINE ID no. ME04477 at SEQ ID NO. 742
MAEEHRCQAAQRLCANNCGFFGSPAMQDLCSKCYRDLQMKEQRSSSAKLVLNQTLIPQQSNSSSLDTGIIHPSSTSPSVMIVSSSTPTVELVAAAAGPSEAEPPKVQPNRCGTCRRRVGLTGFKCRCGLTLCGTHRYPEQHGCGFDFKGMGREEIKKANPVVKGEKLNKI

SEQ ID NO: 893 - protein, 408 aa, Zea mays; identical to SEQ ID NO: 769
  misc_feature: Public GI ID no. 194708220
  misc_feature (1)..(408): Bit score of 140.4 for hmm based on sequences of FIGURE 12.
  misc_feature (49)..(226): Pfam Name: HSF_DNA-bind Pfam Description: HSF-type DNA-binding
  misc_feature: Functional Homolog Of SEQ ID NO. 311

SEQ ID NO: 894 - protein, 408 aa, Zea mays; identical to SEQ ID NO: 774
  misc_feature: Public GI ID no. 194689430
  misc_feature (1)..(408): Bit score of 140.1 for hmm based on sequences of FIGURE 12.
  misc_feature (49)..(226): Pfam Name: HSF_DNA-bind Pfam Description: HSF-type DNA-binding
  misc_feature: Functional Homolog Of SEQ ID NO. 311

SEQ ID NO: 895 - DNA, 1450 bp, Gossypium hirsutum
  misc_feature: Ceres CLONE ID no.1919624
  misc_feature: Encodes the peptide sequence at SEQ ID NO 896
actactcctagtcattttgtcattgccattgttatcttctctgttttttttcttcactctcttcagaacaagttaagaaagaagaatgactaaccaacaaaatgtggtggttgtggatgtgaaaccccatggtgctgttaagccaccattatcatttccagtggccaagtccttttcaccacaagacctgaagttattgttaatgaagaaaaggttcgaaactgagaatgcttgggtactggattccatgagagcttcttcacctactcgtatcagcaaccctactacgacttccttacctgaaactgatgtcaaaagttcctggattgtccatcatccctcagctttgaacatgtttgaacaaatagtgactgcttcagaagggaaacagattgcgatgttccttgactacgatggcacactgtcaccaatcgttgaagacccggatcgagctttcatgcccagagagatgagagcagctgtaagagatgttgcaagatattttcctactgcaatactcaccggaagatgcagagacaaggtttacagctttgtaaaactatctggactttattatgctggtagccatggtatggatatcaagggaccatccaaaagttgcaaagacaataataatggtaagcagggagtgcttttccagcctgcaagtgaattcttgcccatgattgatgaggtgtacaaagcattggtagagaaaacaaattccattccaggagccaaggtggaaaacaacaagttttgtgtttccgtacactatcgatgtgttgatgaaaagagttgggctacaatagctgagcaagttagatcagtgctgaaccactaccctaagcttaaattaactcaagggaggaaggtattagagatacgtcccactatcaaatgggacaaagggagagcccttgaatttttgttggaagcactaggatataacaatgcaaatgatgttttaccaatttatatcggcgatgatcgaactgatgaagatgctttcaaggttttacgtgatagaggactaggatttgggattttggtttcaaaaatacccaaagaaactaatgcatcctattctctccaagaaccatcggaggcacgatttattactaattttggcatattttgctcttctttaatttaaatatatttttggtctataattgttcataaaaacataattattttcaggttaaggagttcttgcgacgtttggtggagtggaaaaagttgtcgctacaaacacccataattggctaaaattaagtgcttatagaggaccttgctgaattatttaatgttctggtttagagagagtttttataattgtaattaaataccagtgttcagaggctgataaaaaagaaaaaagaaaaaaaagaattgttccattaatttggaaattctttaaatcgaccaaaaaaaaaaaaaaaaaaaa

SEQ ID NO: 896 - protein, 356 aa, Gossypium hirsutum
  misc_feature: Ceres CLONE ID no.1919624
  misc_feature: Bit score of 640.2 for HMM based on sequences of FIGURE 9.
  misc_feature (106)..(340): Pfam Name: Trehalose_PPase Pfam Description: Trehalose-phosphatase
  misc_feature: Functional Homolog Of Ceres SEEDLINE ID no. ME20095 at SEQ ID NO. 1129
MTNQQNVVVVDVKPHGAVKPPLSFPVAKSFSPQDLKLLLMKKRFETENAWVLDSMRASSPTRISNPTTTSLPETDVKSSWIVHHPSALNMFEQIVTASEGKQIAMFLDYDGTLSPIVEDPDRAFMPREMRAAVRDVARYFPTAILTGRCRDKVYSFVKLSGLYYAGSHGMDIKGPSKSCKDNNNGKQGVLFQPASEFLPMIDEVYKALVEKTNSIPGAKVENNKFCVSVHYRCVDEKSWATIAEQVRSVLNHYPKLKLTQGRKVLEIRPTIKWDKGRALEFLLEALGYNNANDVLPIYIGDDRTDEDAFKVLRDRGLGFGILVSKIPKETNASYSLQEPSEARFITNFGIFCSSLI

SEQ ID NO: 897 - protein, 459 aa, Oryza sativa subsp. indica
  misc_feature: Public GI ID no. 166787940
  misc_feature (1)..(459): Bit score of 102.9 for hmm based on sequences of FIGURE 12.
  misc_feature (19)..(187): Pfam Name: HSF_DNA-bind Pfam Description: HSF-type DNA-binding
  misc_feature: Functional Homolog Of SEQ ID NO. 311
MESSNLGGGGGGGGGGGPPPFLIKTYEMVEDAATNHVVSWGPGGASFVVWNPLDFSRDLLPKYFKHNNFSSFIRQLNTYGFRKIDPERWEFANEDFIRGHTHLLKNIHRRKPVHSHSLQNQINGPLAESERRELEEEINRLKYEKSILVADLQRQNQQQYVINWQMQAMEGRLVAMEQRQKNIVASLCEMLQRRGGAVSSSLLESDHFSKKRRVPKMDLFVGDCAAGEEQKVFQFQGIGTDAPAMPPVLPVTNGEAFDRVELSLVSLEKLFQRANDACTAAEEVYSHGHGGTEPSTAICPEEMNTAPMETGIDLQLPASLHPSSPNTGNAHLHLSTELTESPGFVQSPELPMAEIREDIHVTRYPTQADVNSEIASSTDTSQDGTSGTEASHGPTNDVFWERFLTETPRSCLDESERQESPKDDVKAELGCNGFHHREKVDQITEQMGHLASAEQTLHT

SEQ ID NO: 898 - protein, 435 aa, Pennisetum glaucum
  misc_feature: Public GI ID no. 169637055
  misc_feature (1)..(435): Bit score of 60.6 for hmm based on sequences of FIGURE 12.
  misc_feature (12)..(176): Pfam Name: HSF_DNA-bind Pfam Description: HSF-type DNA-binding
  misc_feature: Functional Homolog Of SEQ ID NO. 311
MEAGGGGASSLPPFLSKTYEMVDDPATDAVVAWTPPGTSFVVVNRAEFCRDLLPKYFKHNNFSSFVRQLNTYGFRKVDPEQWEFLNDDFIRGQRHRLKNIHRRKPIFSHSSHPHGSGPLADNERREYEEEIEKLKRDNDALTLELEKNAQKKIDMERRMQELEDKLICLEDRQKNLIAYVRDIVQAPGFRSSFVQQPDHHGKKRRLPIPISLHQDENAEGNQIVHGALTNPLVCIESFDKMESSLNSLENFFREASGAFDISYDGGVPGPSSAVVITELHSSGESDPRVPSPPSRMHTSSAGAGDSLSSHDVTESTSCAESPPLPQMTTFDNSRAKVSEIDVNLEPAITETGPSRDQAPEDSPHPAPGTNDGFWEQFLTEQPGSNTHQEAQSERRDGDNKVDQARIGDRENLWWGKKNVEQMTEKLGHLTSAEKT

SEQ ID NO: 899 - DNA, 807 bp, Triticum aestivum
  misc_feature: Ceres CLONE ID no.634261
  misc_feature: Encodes the peptide sequence at SEQ ID NO 900
aaccaaacgcaatatcgccctgcccctccctcttcctcgtcgacgcgcaggccccagggaaattctccgttggagaaaagtcgcgtgccgtctctcgcccacagcccgttggcagcaatggcacaagagagctggaaggagtctgaggagactgtccaaacacctgaggcaccaatattgtgtgtaaacaactgcggcttcttcggtagcagcatgacaaacaacatgtgctccaagtgctacagggacttcattaaggccacgacaatggctgcccctgtagtggagaagaaggtgttctcagtggcatcatcttccagtgtgacattggagcaagcaaaggcagatgaagtaccagccgtggctgtagctgatagccaagcagcacaggagcctccaaagccgcccagcaacagatgcctttcatgccgcaagaagataggcttgaccggtttccagtgccggtgcgggggaacattctgctccatgcaccgctacgctgactcccacgaatgcactttcgactacaagaaggctggccgggagcagattgccaagcagaaccctgttgtgatagccaagaagatcaacaagatataattgataatgacaccgggttcatttgcttgctattcgtggtggtgctggattcgtctttacttgaatcagtaggtttcttctggtctggttgctagggtctcaattgtgtctatccttctccttcatggttcgcttctctccattaagaatgaaatgaaataatgtaaatatataatattatattgttttagctgttcgtttcgtatg

SEQ ID NO: 900 - protein, 160 aa, Triticum aestivum
  misc_feature: Ceres CLONE ID no.634261
  misc_feature: Bit score of 308.9 for HMM based on sequences of FIGURE 7.
  misc_feature (101)..(141): Pfam Name: zf-AN1 Pfam Description: AN1-like Zinc finger
  misc_feature (19)..(43): Pfam Name: zf-A20 Pfam Description: A20-like zinc finger
  misc_feature: Functional Homolog Of Ceres SEEDLINE ID no. ME04477 at SEQ ID NO. 742
MAQESWKESEETVQTPEAPILCVNNCGFFGSSMTNNMCSKCYRDFIKATTMAAPVVEKKVFSVASSSSVTLEQAKADEVPAVAVADSQAAQEPPKPPSNRCLSCRKKIGLTGFQCRCGGTFCSMHRYADSHECTFDYKKAGREQIAKQNPVVIAKKINKI

SEQ ID NO: 901 - protein, 389 aa, Vitis vinifera
  misc_feature: Public GI ID no. 157354692
  misc_feature (1)..(389): Bit score of 76.4 for hmm based on sequences of FIGURE 12.
  misc_feature (12)..(184): Pfam Name: HSF_DNA-bind Pfam Description: HSF-type DNA-binding
  misc_feature: Functional Homolog Of SEQ ID NO. 311
MDESPGSSNSPPPFLTKTYEMVDDPTTDSIVSWSQTNKSFIVWNPEDFSRDLLPRFFKHNNFSSFIRQLNTYGFRKIDSEQWAFANEDFIRGQPHLLRNIHRRKPVHSHSIQNQKGQGTSCPLSESDREGYRADIERLKHDKGALLLELQRHKEDRQGLELQMQHLKDRLQHMEQRQQTVISYLARMLQKPGLALSFLPSMETHNRKRRLLTSNCFYDESDVEENRIATSHTVNTEKLDATSVLELVEFLESSLSSWEDILDEFRPTSGTLIHPWSISYIQLNIDTRSKSTGIDMNCKPAATAPEVTTLKEQVVGAASPVPTGVNDVFWEQFFTENPDSSAEEVQLERKDDESRKNEGKHGDHGRFWWNARSANKLADQMGQLTPAERT

SEQ ID NO: 902 - protein, 185 aa, Picea sitchensis
  misc_feature: Public GI ID no. 116791212
  misc_feature (1)..(185): Bit score of 182.8 for hmm based on sequences of FIGURE 14.
  misc_feature: Functional Homolog Of SEQ ID NO. 2
MDTCPARKKSITLKYDIISSLAAAGIPSLNQKKLRRLPHVFCRVLELPFNSEVPVAVEENGECFRFVVSCDEALAFQEARAEIIEIAPGVIKVVIREASRRLRFSMDDLELDMWRFRLPSSTLPELSTAIYRDGELVVIVPKDVPTSDSEEEEDEGKGSLVEAREGDFSERNEESGMKSGNMVGC

SEQ ID NO: 903 - DNA, 684 bp, Glycine max
  misc_feature: Ceres Clone ID no. 707774
  misc_feature: Encodes the peptide sequence at SEQ ID NO. 904
aataaatccacaaattacaacaatatcacatttccctctctaaccatatttacaacatccaaacagggacttaaaattactagaattggagttattaagctatcacagcatgttcgcgaagaaacgctcccagcacggcggcgtcgtttcatcgatgccgagctcgaacgcgaagaagctattgagactgccgcacgtgttcgcgaaaatactagagcttccttttccctcagacgacgacgttttggtggaggaaacgccgcagttttttcgcttcgtggcgtcgtgcaacgccggtggtgtgcgagctctggccatcgagattcttccggggataacaaaaatcgtcatcaagagaatggacggtggtgacgtggcggtggcgggtcggcatcagcaggttccttcaggatttggtctgtggcggttccgccttccgccggggacgcagccggagatggtcaccgccgtgagcatcggcgggaagctggtggtgacggtgcccaagatcaagagcagagcaaactgattccatctccaactccaaccatacgtggaatataagagaggcgtgtgctttggaaagtagcgtttgtagataaacaatgtattgcatatcgcatatgtgatatgtggcctctttagatgttcgcttttttytccaataaamccmcgattacatcc

SEQ ID NO: 904 - protein, 139 aa, Glycine max
  misc_feature: Ceres Clone ID no. 707774
  misc_feature (1)..(139): Bit score of 101.2 for hmm based on sequences of FIGURE 14.
  misc_feature: Functional Homolog Of SEQ ID NO. 2
MFAKKRSQHGGVVSSMPSSNAKKLLRLPHVFAKILELPFPSDDDVLVEETPQFFRFVASCNAGGVRALAIEILPGITKIVIKRMDGGDVAVAGRHQQVPSGFGLWRFRLPPGTQPEMVTAVSIGGKLVVTVPKIKSRAN

SEQ ID NO: 905 - DNA, 438 bp, Solanum lycopersicum
  misc_feature: Ceres Annot ID no. 8461466
  misc_feature: Encodes the peptide sequence at SEQ ID NO. 906
atgaaggttcatccagtaacaagtaacgttttgtctccggctaacggctcagtttgccggaaaaagaagctccggagactacctcatatttttgccaaggttctagaacttccttttcattccgattctgatgtttcaatccacgaaacttctgattcgttgcgatttgtcatcccaacagatgatgtcggcgataatattagagctcacatagttgagatctatccgggtgttactaagattgttatccgagctgataacgtttttgattcttcattggacctcgacttgtggcgatttcggcttccggccacaactctgccggaactggctagtgcccgttttagtgacggtgaattggtggtcacggtgcccaaaggggaggaggaagacgacggcgatatcgtccgagcaggtggttttgttctcgtacaataa

SEQ ID NO: 906 - protein, 145 aa, Solanum lycopersicum
  misc_feature: Ceres Annot ID no. 8461466
  misc_feature (1)..(145): Bit score of 211.7 for hmm based on sequences of FIGURE 14.
  misc_feature: Functional Homolog Of SEQ ID NO. 2
MKVHPVTSNVLSPANGSVCRKKKLRRLPHIFAKVLELPFHSDSDVSIHETSDSLRFVIPTDDVGDNIRAHIVEIYPGVTKIVIRADNVFDSSLDLDLWRFRLPATTLPELASARFSDGELVVTVPKGEEEDDGDIVRAGGFVLVQ

SEQ ID NO: 907 - DNA, 803 bp, Zea mays
  misc_feature: Ceres Clone ID no. 260703
  misc_feature: Encodes the peptide sequence at SEQ ID NO. 908
  misc_feature (200)..(200): n is a, c, t, g, unknown, or other
aaatcatcacaggtccaaagcgcttccgattctctcttctcccctccgcccgcctccggttgtcttctccaattccccaacgcagccagcagcgcaaggtccagaagcccaggaccagacgacggacctccgcgccccatcgatccgcgcggccctcccccaacgcgcgtgcgtccgcaactagcgtctgcygccggtynctttcttccgcaccccccgacgcggcaaggagcccccccgccatgagggtccacccggccccgcggaagcgcaccatckyygtgcaacgctgcgcctccgcggcggcgggcgcgctcggcgggaagaagctgcgccgcctgccgcacatattcgacaaggtgctggagctcccgttcgcggccgacgcggacgtgtccgtcgaggaggacgcggcggcgctgcggttcgtcgccgccgccgacgagttctccctcgcgggcgcccgcgcgcacgccgtcgagatccacccaggggtcaccaaggtcgtcgtccgcggcctctcctcctcctccctcggcggcgatggcgacgacgacgacgacggggccgccgccgccgycttcgagctcgaccgctggcgcttccgcctcccgccctgcacgcgccccgccatggccaccgccacctacgccgcgggcgagctcgttgtcaccgtccccaagggcgccggccccggcgacggcggcgcggccgctgtcctcggtggcacggagcgcgtccttgtgcttgtatagtatagtaaatctagcttttccctaaattatatatcatctgctttgtgc

SEQ ID NO: 908 - protein, 170 aa, Zea mays
  misc_feature: Ceres Clone ID no. 260703
  misc_feature (1)..(170): Bit score of 313.2 for hmm based on sequences of FIGURE 14.
  misc_feature: Functional Homolog Of SEQ ID NO. 2
  misc_feature (13)..(13): Xaa is any aa, unknown, or other
  misc_feature (113)..(113): Xaa is any aa, unknown, or other
MRVHPAPRKRTIXVQRCASAAAGALGGKKLRRLPHIFDKVLELPFAADADVSVEEDAAALRFVAAADEFSLAGARAHAVEIHPGVTKVVVRGLSSSSLGGDGDDDDDGAAAAXFELDRWRFRLPPCTRPAMATATYAAGELVVTVPKGAGPGDGGAAAVLGGTERVLVLV

SEQ ID NO: 909 - DNA, 736 bp, Zea mays
  misc_feature: Ceres Clone ID no. 340990
  misc_feature: Encodes the peptide sequence at SEQ ID NO. 910
aaggtccagaagcccagaaccagacgagcacggacggatctcccccaacgcgcgtgcgtccgcaactagcgtctgccgccggccgccttcttccgcaccccccgacgcggcaaggagccccccgccatgagggtccacccggccccgcggaagcgcaccatcgccgtgcaacgctgcgcctccgcggcggcgggcgcgctcggcgggaagaagctgcgccgcctgccgcacatattcgacaaggtgctggagctcccgttcgcggccgacgcggacgtgtccgtcgaggaggacgcggcggcgctgcggttcgtcgccgccgccgacgagttctccctcgcgggcgcccgcgcgcacgccgtcgagatccacccaggggtcaccaaggtcgtcgtccgcggcctctcctcctcctccctcggcggcgatggcgacgacgacgacgacggggccgccgccgccgccttcgagctcgaccgctggcgcttccgcctcccgccctgcacgcgccccgccatggccaccgccacctacgccgcgggcgagctcgttgtcaccgtccccaagggcgccggcgccggcgacggcggcgcggccgctgtcctcggtggcacggagcgcgtccttgtgcttgtatagtaaatttagcttttccctaaatttatatatatatcatctggtttgtgcactccgtcactggtttctccctaaattaatttctgctaatcctctgtcg

SEQ ID NO: 910 - protein, 170 aa, Zea mays
  misc_feature: Ceres Clone ID no. 340990
  misc_feature (1)..(170): Bit score of 314.1 for hmm based on sequences of FIGURE 14.
  misc_feature: Functional Homolog Of SEQ ID NO. 2
MRVHPAPRKRTIAVQRCASAAAGALGGKKLRRLPHIFDKVLELPFAADADVSVEEDAAALRFVAAADEFSLAGARAHAVEIHPGVTKVVVRGLSSSSLGGDGDDDDDGAAAAAFELDRWRFRLPPCTRPAMATATYAAGELVVTVPKGAGAGDGGAAAVLGGTERVLVLV

SEQ ID NO: 911 - DNA, 870 bp, Zea mays
  misc_feature: Ceres CLONE ID no.1387149
  misc_feature: Encodes the peptide sequence at SEQ ID NO 912
aaaaacaggttaacaacaacacatacacatctctctctctctctcttcttcgttttatatttccattctttttcttcatttccgccatttctgttttattttggttgccgagaaaacgcaggaactcggtgacctaattatagtctcgtcgattgtctttttcagaattttcgacgaattttattgattaataattaattaatggcggaagaacatccatgtcagacgccggaaggccaccgtctctgcgttaacaactgcggtttcttcggaagctcagccaccatgaatctctgctccaactgctacggcgacctctgcctcaagaaccagcagcaagcttccatgaaatcaaccgtcgagtcctccctctccgccgcatctcctccgtcgtcaccggagatccagtcaatctccacgtcgacgatcgcgcccgtcgtccaaatttacgcggcggagatacagatagagaaacaaatccagcagcaacggcctaatcggtgcaccgtgtgcaggaaacgggtcgggttaaccgggttcatgtgccggtgcgggacgactttctgcgggacccacaggtatccggaggttcacggatgcacgttcgatttcaaatcggctgggcgcgaggagatcgcgaaggctaacccgttggttgtagccgcgaagctccagaagatatgatctgagccgttgcttgcgttgttcaccgtgaaacatacttttatgttacggacatgtgtttacgtaattaatggttgagacagttttcattcaccttttaattattttccttttcttccggaagaattttaaagttttataattgtgtggctttgtgcttgtaaaaaaaaagattttcttttgcgg

SEQ ID NO: 912 - protein, 160 aa, Zea mays
  misc_feature: Ceres CLONE ID no.1387149
  misc_feature: Bit score of 378.8 for HMM based on sequences of FIGURE 7.
  misc_feature (101)..(141): Pfam Name: zf-AN1 Pfam Description: AN1-like Zinc finger
  misc_feature (13)..(37): Pfam Name: zf-A20 Pfam Description: A20-like zinc finger
  misc_feature: Functional Homolog Of Ceres SEEDLINE ID no. ME04477 at SEQ ID NO. 742
MAEEHPCQTPEGHRLCVNNCGFFGSSATMNLCSNCYGDLCLKNQQQASMKSTVESSLSAASPPSSPEIQSISTSTIAPVVQIYAAEIQIEKQIQQQRPNRCTVCRKRVGLTGFMCRCGTTFCGTHRYPEVHGCTFDFKSAGREEIAKANPLVVAAKLQKI

SEQ ID NO: 913 - protein, 168 aa, Vitis vinifera
  misc_feature: Public GI ID no. 157336501
  misc_feature (1)..(168): Bit score of 328.3 for hmm based on sequences of FIGURE 14.
  misc_feature: Functional Homolog Of SEQ ID NO. 2
MKVHPVQKKRNITFRYEINSNLSDPLRDRLMGSTQKKLRRLPHIFSRVLELPFKSDADVAVEESSDCFRFVAVTDGIGDIRAHTVEIHPGVTKIVIRGSDVVELTMDELELDMWRFRLPATTRPELASAVYVDGELVVTVPKCVGMEGAGGGGGELRGGVGGRLVVVL

SEQ ID NO: 914 - protein, 166 aa, Vitis vinifera
  misc_feature: Public GI ID no. 157347959
  misc_feature (1)..(166): Bit score of 242.2 for hmm based on sequences of FIGURE 14.
  misc_feature: Functional Homolog Of SEQ ID NO. 2
MKANPTPKKRSISLQYDIVSTLSEANRLVSSQKKLRRLPHIFTRVLELPFRSDADVSVTETPDHLRFAVTTDDVGDDVRTQTIQLHPGVTKVVIRGRNFLDLSLDGLGVELDLDLWRFRLPASTLPEMASAAYSDGELVVTVPKCGADDDEEGVWSAGTRPLVLVQ

SEQ ID NO: 915 - protein, 157 aa, Zea mays; identical to SEQ ID NO: 60
  misc_feature: Ceres CLONE ID no.1218065
  misc_feature (64)..(123): Pfam Name: DnaJ Pfam Description: DnaJ domain
  misc_feature: Bit score of 386.5 for HMM based on sequences of FIGURE 10.
  misc_feature: Functional Homolog Of Ceres CLONE ID no. 31309 at SEQ ID NO. 60

SEQ ID NO: 916 - protein, 358 aa, Triticum aestivum
  misc_feature: Ceres CLONE ID no.677797
  misc_feature: Bit score of 555.1 for HMM based on sequences of FIGURE 9.
  misc_feature (107)..(340): Pfam Name: Trehalose_PPase Pfam Description: Trehalose-phosphatase
  misc_feature: Functional Homolog Of Ceres SEEDLINE ID no. ME20095 at SEQ ID NO. 1129
MTNHAAFAAEDAVTAVAAPVQPGRHFASFPPRRARDCRKAALGRMDLATSGVLMAGSLLDSMKASSPRHAMPPAGADHEEWIEKHPSALEWFEGVLAATEGKQIVMFLDYDGTLSPIVQDPDRAVMTEEMRDAVRGVAQHFPTAIVSGRCRDKVFNFVKLEELYYAGSHGMDIKGPTKVSNHKAKADEVLCQPATEFLPVIQEVYEKLTAKMESIPGAMVENNKFCLSVHFRCVEEAEWDALGREVKAVLDDYPKLCLTKGRKVLEIRPSIEWNKGHALKFLLKSLGYAGRSDVFPIYIGDDRTDEDAFKVLRNMGQGIGILVTKFPKDTSASYSLREPAEVKEFLRKLVKSNATKKG

SEQ ID NO: 917 - DNA, 944 bp, Zea mays
  misc_feature: Ceres CLONE ID no.1423851
  misc_feature: Encodes the peptide sequence at SEQ ID NO 918
agagaactttattctctcctctaacctctcaacttctgctggatctctccagcagacggaagatcttcttcggagagattcttaggggaccgaacgatctatcgatcaaggcttctcgggcaaacagaaatggaccacgacaagacaggatgccaaagcccacccgagggtcccaagctatgcatcaacaactgcggtttcttcggaagcgctgccacaatgaacatgtgttccaagtgccacaagactatcttgtttcaacaggaacagggggccaagcttgcatctgcagtgtctggatcacccagcaacatcctaaaggaaaccttcactgctgatttggttgatgctggaaccaaatccatcgagcctgtggctgtctctgtacaagctgttgcagaggtagtagcaccagaagaagctgcagcaaaaccaaaggaagggcccagccgatgtactacttgcaacaaacgggttggtttgactggattcaaatgtcgatgtggtgacctcttctgtggtacgcaccgctatgcagacgttcataactgctctttcgattaccatgttgctgcgcaagaagctatagccaaagcgaacccggttgtgaaggcagataagcttgacaagatctgaaactcagaaactatgtttccttcttcatgtccgtgtctggttcaagcgtgtgttgatctttagcttcttccgttctctctgccagtatctgtggtgtgaaaactttctatattatcttgtgtttgcaagcagagaagtgtgctcttaaatatatatatatgctttgatgtgtttctctttttttttttttaatattatttatgagcactatggtttggttatgtttactcctttgggtctgtatcatattgagattgtaactttagctatatgaagatttttcttaaaagctaaaaaaaaaaaaaaaa

SEQ ID NO: 918 - protein, 168 aa, Zea mays
  misc_feature: Ceres CLONE ID no.1423851
  misc_feature: Bit score of 266.5 for HMM based on sequences of FIGURE 7.
  misc_feature (109)..(149): Pfam Name: zf-AN1 Pfam Description: AN1-like Zinc finger
  misc_feature (15)..(39): Pfam Name: zf-A20 Pfam Description: A20-like zinc finger
  misc_feature: Functional Homolog Of Ceres SEEDLINE ID no. ME04477 at SEQ ID NO. 742
MDHDKTGCQSPPEGPKLCINNCGFFGSAATMNMCSKCHKTILFQQEQGAKLASAVSGSPSNILKETFTADLVDAGTKSIEPVAVSVQAVAEVVAPEEAAAKPKEGPSRCTTCNKRVGLTGFKCRCGDLFCGTHRYADVHNCSFDYHVAAQEAIAKANPVVKADKLDKI

SEQ ID NO: 919 - DNA, 835 bp, Panicum virgatum
  misc_feature: Ceres Clone ID no. 1955889
  misc_feature: Encodes the peptide sequence at SEQ ID NO. 920
agcgagagcagaggagacaccacgaaaggaacccgagagagggggaaaaaaaacttcggttttggagctcttggcttgttgcgagcacatgaggatccacccagcagcagcagctcccgccggcggcaagaaggacctccgccggcttccgcacgtgtacagcaaggtgctcgagctgctgctcccggcggacaccgacgtcgaggtgttcgaaggccccgacgccttccacttcgtcgccgccggtgcgcgaggcgccggcgtggtgcaggtgcgcaccgtgaggatccaccccggggttaccaaggtagtggtgcaggcaggtggcgccggaggcgctgaggaggctggcgccgacgacatggagctcgacaggtggcggtcccggctgcccgaggcgagtcgtccggcgatggcggtggctgggtacgtcgacgggcagctcgttgtgacagttccaaaggggcgtgaaggcagcgaaggcgccgatgccgggcaaggtgaggttacctggagatgctgcagcggaggaaagattagtggaagactggtggttgtacagtagtagtagagaatatatagtgcgttggtcgtcatctaatcaaaatctagtactatgtagtaatgtcttgccatctttgttttttttcctgaagatgggctgtttattatgttacttccctggcctggttttagcatcagagatgtttcatgagcgataccttccggctggttcttaagcgtatagaaacagctattgtaaattctctttgatttccttgaaatcaaatgtaaattctagatggaccaaagactcttgagatagccttatcct

SEQ ID NO: 920 - protein, 158 aa, Panicum virgatum
  misc_feature: Ceres Clone ID no. 1955889
  misc_feature (1)..(158): Bit score of 339.1 for hmm based on sequences of FIGURE 14.
  misc_feature: Functional Homolog Of SEQ ID NO. 2
MRIHPAAAAPAGGKKDLRRLPHVYSKVLELLLPADTDVEVFEGPDAFHFVAAGARGAGVVQVRTVRIHPGVTKVVVQAGGAGGAEEAGADDMELDRWRSRLPEASRPAMAVAGYVDGQLVVTVPKGREGSEGADAGQGEVTWRCCSGGKISGRLVVVQ

SEQ ID NO: 921 - DNA, 975 bp, Sorghum bicolor
  misc_feature: Ceres Annot ID no. 8632003
  misc_feature: Encodes the peptide sequence at SEQ ID NO. 922
atgtgccacatgcgccagctccacccagattctgacaacgccttcccaacccgcatcgacagcgcgcacttggattcggcgacgccggagcgcggaggaggcaagcgccgatccagagacgatggccgccgcgggctcctcgccgtcatcctcctcaagcaagcgcccaggttggaagggaaggtggccctcgtcaccggtggcgccaccggcatcggcgaagccatcgttcgcctcttcacggagcacggcgccaaggtctgcatcgcggacatccaggacgaggccgggcagcagctgcgcgacgccctgggaggcgacgcgcagggcgtcatgttcgtccactgcgacgtgacgtcggaggaggacgtgagccgcgccgtggacgcggcggcggagcggttcggcgcgctggacgtgatggtgaacaacgcgggcgtgacgggtgccaaggtgacggacatccgtgccgtggacttcgccgaggtgcgccgggtgctcgacatcaacgtgcacggcgtgttcctggggatgaagcacgcggcgcgcgtcatgatcccgcagaagcggggctccatcgtgtcgctggccagcgtggccagcgccatcggcgggctgggcccgcacgcgtacacggcgtccaagcacgccgtggtcgggctcaccaagagcgtcgccgcggagctcggccgccacggggtgcgcgtcaactgcgtgtccccctacgccgtgcccacggcgctgtccatgccgcacctgccccagggcgcgcgcgccgacgacgcgctcacggacttcctggccttcgtcggcggcgaggccaacctcaagggcgtcgacgccatgcccaaggacgtcgcccaggcggtgctatacctggccagcgacgaggcgaggtacgtcagcgcgctcaacctcatggtggacggcggcttcacagccgtcaaccataacctcaggccattcgatgattag

SEQ ID NO: 922 - protein, 324 aa, Sorghum bicolor
  misc_feature: Ceres Annot ID no. 8632003
  misc_feature (1)..(324): Bit score of 677.2 for hmm based on sequences of FIGURE 8.
  misc_feature (61)..(230): Pfam Name: adh_short Pfam Description: short chain dehydrogenase
  misc_feature: Functional Homolog Of SEQ ID NO. 1012
MCHMRQLHPDSDNAFPTRIDSAHLDSATPERGGGKRRSRDDGRRGLLAVILLKQAPRLEGKVALVTGGATGIGEAIVRLFTEHGAKVCIADIQDEAGQQLRDALGGDAQGVMFVHCDVTSEEDVSRAVDAAAERFGALDVMVNNAGVTGAKVTDIRAVDFAEVRRVLDINVHGVFLGMKHAARVMIPQKRGSIVSLASVASAIGGLGPHAYTASKHAVVGLTKSVAAELGRHGVRVNCVSPYAVPTALSMPHLPQGARADDALTDFLAFVGGEANLKGVDAMPKDVAQAVLYLASDEARYVSALNLMVDGGFTAVNHNLRPFDD

SEQ ID NO: 923 - DNA, 831 bp, Solanum lycopersicum
  misc_feature: Ceres Annot ID no. 8455086
  misc_feature: Encodes the peptide sequence at SEQ ID NO. 924
atggcttctgcttcattcctttcaacaatcggcaaaaggctagaggggaaagtagcaattgtaaccggaggagctagtggtatcggtgaagcaattgcaaagctcttctttgaacatggagccaaagtggtcattgctgatgtccaagatgaactcggcaactcggtcatcaacgcccttggcggctcatccaactccatttacatccactgtgacgtcacaaacgaagactacgtccaagaagctgtcgacagaaccatcgccacatttggaaaactcgacatcatgatctgcaatgctggcatatgcgacgagaccaagccaagaatcatcgacaatacaaaagcagattttgaacgagtccttagcatcaatataacaggagttttcttgagcatgaagcatgccgctcgagtcatggtcccgacacgtagcggctgcatcatatccaccgctagtgtaagctccaaggttggagctgcagcatcacatgcttactgcagctccaaacacgccgtgttgggtcttaccaagaacctagcggtggaactaggacaattcggtatacgtgtgaattgcttgtcaccatacgcgatggtcacgccaatggcgacaaagatcattggacttgaaaatgaagagcttgagaacgcgatgagcacgattgggaaccttaaaggtgctactctgaaggtggatgatgttgcaaaagcagcattgttcttagcaagtgatgatgcccagtatatcagtgggcacaatctattcattgatgggggattcactgtgtctaatccaggactaggcatgttcaagtatccagaatcttga

SEQ ID NO: 924 - protein, 276 aa, Solanum lycopersicum
  misc_feature: Ceres Annot ID no. 8455086
  misc_feature (1)..(276): Bit score of 645.5 for hmm based on sequences of FIGURE 8.
  misc_feature (17)..(185): Pfam Name: adh_short Pfam Description: short chain dehydrogenase
  misc_feature: Functional Homolog Of SEQ ID NO. 1012
MASASFLSTIGKRLEGKVAIVTGGASGIGEAIAKLFFEHGAKVVIADVQDELGNSVINALGGSSNSIYIHCDVTNEDYVQEAVDRTIATFGKLDIMICNAGICDETKPRIIDNTKADFERVLSINITGVFLSMKHAARVMVPTRSGCIISTASVSSKVGAAASHAYCSSKHAVLGLTKNLAVELGQFGIRVNCLSPYAMVTPMATKIIGLENEELENAMSTIGNLKGATLKVDDVAKAALFLASDDAQYISGHNLFIDGGFTVSNPGLGMFKYPES

SEQ ID NO: 925 - DNA, 1762 bp, Gossypium hirsutum
  misc_feature: Ceres CLONE ID no.1927040
  misc_feature: Encodes the peptide sequence at SEQ ID NO 926
aaaaaactctctttgattttatacaatctttgggcttcgtttttaatctcttattctctttcgtttctctgttgcatttccacaaatatctccgtgcttccccttttcgttgttttttcccttttctctttacaactgcattttttaaagatcagatcttttccgggtttcacctcatcaatcagatttaagcacattttgatcttgtttcgaatccctgctgttatcgatatcgagaaaagttcaatttttgtcataaattcggtgtagctttggagatgagaagttttcaggtaagctgcgattgatggactgtttatcgccgagaagcagtgataagaagacattgaagaggtggtttttcatagataaaagggttggctaaataagtgtacttcgaaaaaaaaggtgatttgaagctaatggattctaagtctaatcattcatctcctgttcttaccgatccgattccgataaacaagtcaaggttaggcattcattcaaatctactttcatatccacaatctggtggatctttgtcccctggtaagtataagatgactcctaggaagaaacctgcaaaactcgatgatgttcggtctaatggttggttggatgctatgaaatcttcgtctcccccttgtaagaagttgatcaaggggttcaatattgaggttcccgctgatgatatcgatattgcttatcattcctggatgattaaatatccatctgcacttaaatcttttgaggaaatctcgagacatgccaagaacaagaagatagctgttttcctagattatgatggtactctttctcctatcgtagatgatccagatcgagcttttatgtctgatgctatgcgttctgctgtgagaaacgtcgcgaagtattttccgacagctattattagtggcagaagtcgtgataaggtttatgaattggtaggactaactgaacttttttatgctggtagtcatgggatggacattatgggccctgtgaaacatacagagtctgatgatggccatccaaaccgtgttagatcaattgaccaagagggcaaggaggtaaaccttttccagcctgctagagaattcatacctatgattgacgaggtttttagaacccttgtcgagaacactaaagatattaagggtgcaaaggttgagaatcacaagttttgcacctcagtacattaccgtaacgtagaagaaaagaactggcctattattgcgcaatgcgttcatgatattctgaaagactatcctcgtttgcgattaacgcatggacggaaggttttagaggtccgtcctgtgattgactggaataaagggaaggcggttgaatttctgcttgaatctcttgggctaagtgatagagatgatgtgctcccaatctatattggagatgacaaaactgatgaggatgcgtttaaggtcttaaaggaaggaaatatgggttatggaatcttggtatcttcagtgcctaaagaaagcaatgcaattttctctgtcagggacccatcagaggtgaagaaatttctgaaggcactggtgagatggaagaggcttgaagaagcttgaaggaaaagcaaggctttgggagcaaaaaaaaggcagaataaaattttcattgaagaggataatttagtttttatttttatattttgcaaataatgtaattttttccatttcaatttttatcaacgattatcccccaatgaaaccagtcatttttattacaaaaaaaaaaaaaaaaaaaa

SEQ ID NO: 926 - protein, 386 aa, Gossypium hirsutum
  misc_feature: Ceres CLONE ID no.1927040
  misc_feature: Bit score of 960.7 for HMM based on sequences of FIGURE 9.
  misc_feature (123)..(368): Pfam Name: Trehalose_PPase Pfam Description: Trehalose-phosphatase
  misc_feature: Functional Homolog Of Ceres SEEDLINE ID no. ME20095 at SEQ ID NO. 1129
MDSKSNHSSPVLTDPIPINKSRLGIHSNLLSYPQSGGSLSPGKYKMTPRKKPAKLDDVRSNGWLDAMKSSSPPCKKLIKGFNIEVPADDIDIAYHSWMIKYPSALKSFEEISRHAKNKKIAVFLDYDGTLSPIVDDPDRAFMSDAMRSAVRNVAKYFPTAIISGRSRDKVYELVGLTELFYAGSHGMDIMGPVKHTESDDGHPNRVRSIDQEGKEVNLFQPAREFIPMIDEVFRTLVENTKDIKGAKVENHKFCTSVHYRNVEEKNWPIIAQCVHDILKDYPRLRLTHGRKVLEVRPVIDWNKGKAVEFLLESLGLSDRDDVLPIYIGDDKTDEDAFKVLKEGNMGYGILVSSVPKESNAIFSVRDPSEVKKFLKALVRWKRLEEA

SEQ ID NO: 927 - DNA, 1338 bp, Populus balsamifera subsp. trichocarpa
  misc_feature: Ceres ANNOT ID no.1469023
  misc_feature: Encodes the peptide sequence at SEQ ID NO 861
atggacctcaaatcaaatcataatgctcctgtgctcactgattctgctcccctaagcaagtcaaggctacgcgggtaccaccatggtttgatgctgccgtactcaccctcaggtgcacctttctcgtcaaatctattactatctattcctaggaggaaaactggagtgcttgatgatgttcgctcctgtggttggctggatgccatgaaatcatcatctcctactcataagaagtttgccaaggatattaaccatgagctttccgcacctgatccagaagttgcctatcgcacctggctgcttaaatatccatctgcgcttgcatctttcgagcaaattgcaaactttgcaaaaggcaagagaatcgccttatttctggattatgatggtactctttcaccaattgttgaaaatcctgacaatgccttcatgtctgctgatatgcgttccattgtaaaggaagtggcaaaatatttcccaacagcaataatcagtggaagaagccgtgacaaggtgtatgagtttgtagggcttacagaactctactatgcgggtagtcatggtatggatatcatgggccctgtcaggcaatctgtatctgacgaccaccgaaattgtatcaagtctacggacaagcagggcaacgaagttaacttattccagcctgcaagagaatttttacctatgattgacgaggtttatagttcccttgtcaggattaccgaagatattaaaggggcaacagttgagaacaataaattctgtgtctctgtacattaccgtaacgttgatcaagataactggaaatcagttggggagcgtgtccaggatgtcataaagaagtatcctcgcctgcgattgactcatgggaggaaggttttagaaatccgtcccgcgatcaattgggacaaggggaaagctcttgaatttctacttgaatcactagatctcagcaattgtgatgatgtgctgccgatttatgttggagatgaccggacagatgaagatgcatttaaggttttgagagagaggaactgtggttatggcatttttgtatcaaaatcaccgaaggaaagcaatgcgtattactctctcagagacccagcagagcttgagaattcctgtctcaggtggactggatatcctaaaccagaaaaacgttgggagtccaaaatatttgttgtctacgatgatgtttgtgttaatcgggataagcctcttagattggattgttgtcaaaaccctagctatgtggccagaacctcgttggccggtgtaagatgcacagcacttcaggtcaggggtcctagggctgtggaagtggtaatattgacctga

SEQ ID NO: 928 - DNA, 1116 bp, Sorghum bicolor
  misc_feature: Ceres Annot ID no. 8712513
  misc_feature: Encodes the peptide sequence at SEQ ID NO. 929
atgttcagcagagccttgcaggtgattctcagggagaagaagagcaggacgattggtccagccttggtccatgccttcaactcggcttccagctctcaaactcagaggctggctggaaaggtcgccgtcatcaccgggggcgcgagcggcatcggcaaggcgaccgcagccgagttcgtgagaaacggggcgagggtcgtcatcgccgacatccaggacgacctcggccgtgccgttgccgccgagctcggacccgacaacgcgtgctgctacacccactgcgacgtcgccgacgaggcgcaggtcgccgccgccgtggacctcgcagtggcccgccacggccagctcgacgtcatgttcaacaacgccggcatcacgggctcccccgggtgcgggtggccaccgctcggcgccgtggacctcgccgacttcgaccgcgtcatggccgtcaacgcccgcggagtgctggcggggctcaagcacgccgcgcgcgtcatggtgccgcgccgccgcggcagcatcatctgcaccgccagcgtcgccggcctgtgcggcggcatggttgccgtcgcgtacagcgcctccaaggcgacggtgatcggcctggtgcgcgctgtggcggcggagatggcgtcctccggggtgcgcgtcaacgccatctctccctacgccgtcccgacgcctctggcgctggcagcggtcgcctcgaggcaatcgatgaggggattgagcgccgaggagattaagcggagggtggagatagactcgaacgtgatgtacgggacgaagttggaggaggacgacatcgcgagggcggcactctacctggcgtccgacgacgctaagtatgtcaacggccacaacctcgtcgtcgacggcggcttcacggtgagcagagaagtaccaaaaatcctggcacaagcacgcccaaggagtgatgaacggtccgcatggattttacttcgtggcgctgctgacttgctgtacaccagaatccgtgatggtctctcacgaccagcaaataaagcccggacgccactaggttattgccaacatgggatgggcgacggggccacggtcgtcttagcagcggcagttagcctttcagttggataa

SEQ ID NO: 929 - protein, 371 aa, Sorghum bicolor
  misc_feature: Ceres Annot ID no. 8712513
  misc_feature (1)..(371): Bit score of 369.9 for hmm based on sequences of FIGURE 8.
  misc_feature (40)..(211): Pfam Name: adh_short Pfam Description: short chain dehydrogenase
  misc_feature: Functional Homolog Of SEQ ID NO. 1012
MFSRALQVILREKKSRTIGPALVHAFNSASSSQTQRLAGKVAVITGGASGIGKATAAEFVRNGARVVIADIQDDLGRAVAAELGPDNACCYTHCDVADEAQVAAAVDLAVARHGQLDVMFNNAGITGSPGCGWPPLGAVDLADFDRVMAVNARGVLAGLKHAARVMVPRRRGSIICTASVAGLCGGMVAVAYSASKATVIGLVRAVAAEMASSGVRVNAISPYAVPTPLALAAVASRQSMRGLSAEEIKRRVEIDSNVMYGTKLEEDDIARAALYLASDDAKYVNGHNLVVDGGFTVSREVPKILAQARPRSDERSAWILLRGAADLLYTRIRDGLSRPANKARTPLGYCQHGMGDGATVVLAAAVSLSVG

SEQ ID NO: 930 - DNA, 912 bp, Sorghum bicolor
  misc_feature: Ceres Annot ID no. 8657183
  misc_feature: Encodes the peptide sequence at SEQ ID NO. 931
atgggtcgtgatccctgttttacttgctgctgcctgctgcattatgcacatcggagacgctgcaccttaccttggttggtcgaattggtctgtgtgtacgccaggttagctggaaaggtagcggtgatcaccggcggcgcgagcgggatcgggaaggcgacggcagctgagtttgtcaggaacggggcgagggtcatcatcgccgacgtccaggacgacctcggacacgccgtagctaccgagctgggcgccgacgccgtgcgatacacccgctgcgacgtcacggacgaggcgcaggtcgccgcggccgtcgacctcgccgtccagctccacggccgcctcgacgtgatgtacaacaacgcgggcatcggcggcgacatggcggcgtcctcgctgggcgccatcgacctggccgacttcgaccgcgtcatggccgtcaacgcccggggcgtgctggccggcgtgaagcacgccgcgcgcgtcatggtgccgcgccgcaccggcagcatcatctgcaccgccagcaccaccgctgtgctgggcgacatggcccctacgccctactgcgtctccaaggtggcggtcgttggaatcgtgcgcgccgtggccggacagatggcgcgctccggggtgcgcgtcaacgccatctccccgcacgctatcccgacgccgctggcgatggctactatggcgcagtggttccccgataggagcgtcgaggagcatcggcggatcctcgagagggacatgaacgagatggccgggcctgtgctggaggcggaggacattgccagggcggcggtttacctggcgtccgacgaggccaagtacgtgaacggacagaatctggtcgtcgacggcgggtacacggtgagcaaagcgctgaacatgccagcccctgcagcacgctga

SEQ ID NO: 931 - protein, 303 aa, Sorghum bicolor
  misc_feature: Ceres Annot ID no. 8657183
  misc_feature (1)..(303): Bit score of 340.9 for hmm based on sequences of FIGURE 8.
  misc_feature (39)..(207): Pfam Name: adh_short Pfam Description: short chain dehydrogenase
  misc_feature: Functional Homolog Of SEQ ID NO. 1012
MGRDPCFTCCCLLHYAHRRRCTLPWLVELVCVYARLAGKVAVITGGASGIGKATAAEFVRNGARVIIADVQDDLGHAVATELGADAVRYTRCDVTDEAQVAAAVDLAVQLHGRLDVMYNNAGIGGDMAASSLGAIDLADFDRVMAVNARGVLAGVKHAARVMVPRRTGSIICTASTTAVLGDMAPTPYCVSKVAVVGIVRAVAGQMARSGVRVNAISPHAIPTPLAMATMAQWFPDRSVEEHRRILERDMNEMAGPVLEAEDIARAAVYLASDEAKYVNGQNLVVDGGYTVSKALNMPAPAAR

SEQ ID NO: 932 - protein, 372 aa, Arabidopsis thaliana
  misc_feature: Public GI ID no.7960729
  misc_feature: Bit score of 702.9 for HMM based on sequences of FIGURE 9.
  misc_feature (116)..(350): Pfam Name: Trehalose_PPase Pfam Description: Trehalose-phosphatase
  misc_feature: Functional Homolog Of Ceres SEEDLINE ID no. ME20095 at SEQ ID NO. 1129
MSASQNIVVSETTMSSIIPNNNNNNNNSSSQKLPPCLISISKKKLLKNIDIINGGGQRINAWVDSMRASSPTHLKSLPSSISTQQQLNSWIMQHPSALEKFEQIMEASRGKQIVMFLDYDGTLSPIVDDPDKAFMSSKMRRTVKKLAKCFPTAIVTGRCIDKVYNFVKLAELYYAGSHGMDIKGPAKGFSRHKRVKQSLLYQPANDYLPMIDEVYRQLLEKTKSTPGAKVENHKFCASVHFRCVDEKKWSELVLQVRSVLKKFPTLQLTQGRKVFEIRPMIEWDKGKALEFLLESLGFGNTNNVFPVYIGDDRTDEDAFKMLRDRGEGFGILVSKFPKDTDASYSLQDPSEASDGFLTTIGGMETNAAKNVK

SEQ ID NO: 933 - protein, 371 aa, Brassica rapa
  misc_feature: Public GI ID no.72255610
  misc_feature: Bit score of 760.8 for HMM based on sequences of FIGURE 9.
  misc_feature (111)..(345): Pfam Name: Trehalose_PPase Pfam Description: Trehalose-phosphatase
  misc_feature: Functional Homolog Of Ceres SEEDLINE ID no. ME20095 at SEQ ID NO. 1129
MEKPNRMSESQNVVVSEAARSIIPNNSSAPPGFISISKKKLLKNLEIINDGERINAWVDSMRASSPTHPKSLPSSISSEQQLSSWIMQHPSALEMFEKITEASGGKQIVIFLDYDGTLSPIVDDPDRAFMSSKMRRTVKKLAKCFPTAIVTGRCLDKVYNFVKLAELYYAGSHGMDIKGPAKGFSRHKRVKQSLLYQPASDYLPMIDEVYRQLLEKTKSTPGVIVENNKFCASVHFRCVDEKKWSELVLQVRSVLNEYPRLKLNQGRKVFEIRPMIEWDKGKALEFLLESLGFGNSNNVFPVYIGDDRTDEDAFKLLRDRGEGCGVLVSKFPKDTDASYYLQDPSEASDEFLATIGGVETNAAKSVKRMYV

SEQ ID NO: 934 - DNA, 1154 bp, Glycine max
  misc_feature: Ceres Clone ID no. 557012
  misc_feature: Encodes the peptide sequence at SEQ ID NO. 935
atcttcgaagttcaaagtgtaggacgagaaagtagacacagccatgtccactactggtactgttctggcttccactccaacacaaaggctattaggcaaagtggcattggttactggtggagcgtctggaattggagaaagcattgtgcgcctcttccatatccatggtgctaaaatatgtatagctgatgtgcaagacaaccttggaaagcaggtctgtcagtctcttggtgatgaagcaaatgttgtttttgtccattgtgatgttacagtagaggatgatgtttcccatgcagtggacttcactgtgggtaaatttggcacccttcacatcatagtcaacaatgccggaatttctggatcaccttgttccgatatccgcaatgcagacttatcagaattcgataaggtgtttagtgtaaatacgaagggagtgttccacgggatgaaacacgctgctcgaattatgatcccgaagaagaagggctcaatcatttctttatgcagtgtagcaagtgccataggtggcttaggaccgcatgcatacacagggtccaagtatgctgtattggggctcacaaagaatgttgcagctgaattggggaaacatgctataagagtgaactgtgtgtcaccttatggtgttgcaacaggtttggccttggctcatttgcctgaggatgagagaactgatgatgccttggtcagttttcgtgattttactgggagaatggccaacttgcagggggtagaattaactactcacgatgtggctaatgctgtgctcttccttgcaagtgatgatgctaaatatataagtggagagaatctcatggttgatggaggcttcacaagtgcaaatcactcactccaagtttttagatgattaatggtatttcattgtttgttagtttacataatttgaggcattgcaatcctgatgtctagtacaagggttttcagttaacatacaaaacaaaatgaaaatgctcctctaaagtagtcttttttaatttatccttaaattttagatggttagatcatattacactttaaattaaattcgtgtgaaacttatctcctttcaacgaagggaacaaactgtcttattcttctcacccggtcaactctcagcttggctaatgcaaatttac

SEQ ID NO: 935 - protein, 280 aa, Glycine max
  misc_feature: Ceres Clone ID no. 557012
  misc_feature (1)..(280): Bit score of 613.3 for hmm based on sequences of FIGURE 8.
  misc_feature (19)..(187): Pfam Name: adh_short Pfam Description: short chain dehydrogenase
  misc_feature: Functional Homolog Of SEQ ID NO. 1012
MSTTGTVLASTPTQRLLGKVALVTGGASGIGESIVRLFHIHGAKICIADVQDNLGKQVCQSLGDEANVVFVHCDVTVEDDVSHAVDFTVGKFGTLHIIVNNAGISGSPCSDIRNADLSEFDKVFSVNTKGVFHGMKHAARIMIPKKKGSIISLCSVASAIGGLGPHAYTGSKYAVLGLTKNVAAELGKHAIRVNCVSPYGVATGLALAHLPEDERTDDALVSFRDFTGRMANLQGVELTTHDVANAVLFLASDDAKYISGENLMVDGGFTSANHSLQVFR

SEQ ID NO: 936 - DNA, 1022 bp, Glycine max
  misc_feature: Ceres Clone ID no. 1120962
  misc_feature: Encodes the peptide sequence at SEQ ID NO. 937
gctaatagaataggtttcacaccacactaaagccaattagtccctctcttctccctttccttttctctaaccaataatagagctttagaagaaagaaagaaagccatgcaagcatgttcctcctcagacgctccactctccaagaggttagatggcaaagtagcactcataaccggcggagccagtggcatcggtgaagccaccgccaagcttttccttcgccacggtgccaaggtcgtcatcgccgacatccaagacaacctcggacactccctatgccaaagtctcaattcctccgacaaaaacaacaacgacgacatttcctatgttcactgcgacgtcaccaacgacaaagacgtcgaaaccgccgtcaacgctgccgtctcgcgacacggcaagctcgacatcctcttcagcaacgccggcatcacgggccgttccgactgttctaactccatcacggccatcgacagcggtgacctgaagagggtcttcgaggtgaacgtcttcggtgccttctacgccgccaaacacgccgctaaggtcatgattcccagaaagaaagggagcattgttttcactgctagcatcgcttctgtgtcgaatgcgggttgggcgcacccgtacgcggcgtcgaagaacgcagtggtgggtttgatgaagaacctgtgcgtggaattggggaaacatggaatcagagttaactgtgtttcgccctatgcggtggggactccaatgctgacacgtgcgatgaggatggagaaggagaaagcagaggagatatatttggaggcggcgaacttgaagggagtggttttaaaggaaaaggatgtggcagaagcaactttgtttttggctagtgatgagtcaaaatacgtgagtggagtgaatctagttgtggacggaggttatactaccaccaattcttctgccaaacaagctttcacaaagttttcttttaatgtttaagcccaaattgaaagtttcaatttcagggttacttcgaccaaaagttttctgtt

SEQ ID NO: 937 - protein, 287 aa, Glycine max
  misc_feature: Ceres Clone ID no. 1120962
  misc_feature (1)..(287): Bit score of 489.9 for hmm based on sequences of FIGURE 8.
  misc_feature (18)..(193): Pfam Name: adh_short Pfam Description: short chain dehydrogenase
  misc_feature: Functional Homolog Of SEQ ID NO. 1012
MQACSSSDAPLSKRLDGKVALITGGASGIGEATAKLFLRHGAKVVIADIQDNLGHSLCQSLNSSDKNNNDDISYVHCDVTNDKDVETAVNAAVSRHGKLDILFSNAGITGRSDCSNSITAIDSGDLKRVFEVNVFGAFYAAKHAAKVMIPRKKGSIVFTASIASVSNAGWAHPYAASKNAVVGLMKNLCVELGKHGIRVNCVSPYAVGTPMLTRAMRMEKEKAEEIYLEAANLKGVVLKEKDVAEATLFLASDESKYVSGVNLVVDGGYTTTNSSAKQAFTKFSFNV

SEQ ID NO: 938 - DNA, 796 bp, Zea mays
  misc_feature: Ceres CLONE ID no.1589047
  misc_feature: Encodes the peptide sequence at SEQ ID NO 939
agttgcccccacccagaccaaacccaggcttcccgttccctcgcttttgtccggcggccatggcggaggagcagcagcatcagagatggcaggagggccaccgcctgtgcgccaacaattgcggcttcttcggcagccccgcgacgctggacctctgctccaagtgctaccgcgacctataccagcagcagccagcaggcgcggcggcgggcccctccgctcccaccgcgtcggccttccagcattcctcctcggcagtctccggcgcggcggcggtctctcccgatctcgaacctcccgcgacggcccctgctggcgccaaggcgggcaggtgctccagctgccggaagcgcgtgggcctgacggggttcgcgtgccgctgcggagctaccttctgcggcgtgcaccgctacccggagcggcacgcgtgcgccttcgatttccgggccgccggccgcgacgccatcgcgcgcgccaaccccgtcgtcaagggcgataagctcaaggacaagatctgaggagcaggaaccgccgcctctcgcttcagagttcatgtcttccccccgtcagcggaactccggaagagcaaggacgaccgacggccagaagggacggatcgtcggattgtacgaattactcccgtgtactctacgattggtataaaacccaagcccgtcggttcgattgtgtaaagctggcggtgaaatcgctggccgtttactgaatgaaaaaaaattcaaatagaaaaatatttacttttcaaaaaaaaaaaaaaaaaaaaaaaaaaaaaaaaaaa

SEQ ID NO: 939 - protein, 152 aa, Zea mays
  misc_feature: Ceres CLONE ID no.1589047
  misc_feature: Bit score of 257.4 for HMM based on sequences of FIGURE 7.
  misc_feature (14)..(38): Pfam Name: zf-A20 Pfam Description: A20-like zinc finger
  misc_feature (92)..(132): Pfam Name: zf-AN1 Pfam Description: AN1-like Zinc finger
  misc_feature: Functional Homolog Of Ceres SEEDLINE ID no. ME04477 at SEQ ID NO. 742
MAEEQQHQRWQEGHRLCANNCGFFGSPATLDLCSKCYRDLYQQQPAGAAAGPSAPTASAFQHSSSAVSGAAAVSPDLEPPATAPAGAKAGRCSSCRKRVGLTGFACRCGATFCGVHRYPERHACAFDFRAAGRDAIARANPVVKGDKLKDKI

SEQ ID NO: 940 - DNA, 1187 bp, Glycine max
  misc_feature: Ceres Clone ID no. 1364258
  misc_feature: Encodes the peptide sequence at SEQ ID NO. 941
attgaattcaacctttcatttcgtcactcttgcctgcatatagttttcctcctagctagatacatgatcaagtcctcctccatggcttcaattgccaaaatgcttgaaggcaaagtggcgataatcacaggaggagcaagtggcattggtgccgccaccgccaagctattcgtccaacacggcgccaaagtaatcattgccgacgtgcaagacgagttaggccagttccactgcaaaaccctcggcacaacaaacattcactacgtccactgcgacgtaaccagcgactccgacgtcaaaaacgtggtcgaatttgccgtgtccaagtatggcaagctcgacataatgtacaacaacgccggcatctccggagactcaaatcgctccataacgacatccgacaacgaaggctttaagaatgttttcggggttaacgtgtacggagctttcttgggcgccaagcatgccgctagggtcatgatccccgcaaagagaggggttattctcttcacctcaagcgttgcttcgcttctcggcggcgaaacaacgcacgcttacgctgtttcgaagcacgcggtggtggggctaatgaagaacctgtgcgtggaacttggggaacatgggatcagagtgaattgcgtttgtccaggtggaattcccactccgatgctcaacaatgcgttgaagatgaacaagaaagagacgcaggaagtgctgtgtaaggttgcggtgttgaaaggaacggttcttgaagccgaggacatagccaaagctgcagtttatttgtgcagcgacgaggccaagtttgtgagtggagttaactttgtcttggacggaggttatagcatcaccaataattctttcacttctgcgctcaacgctctcatcaacaacaaccatgcttagtaatggctagctatatatccattcccgcattttctgcccagttccatgtgctgaaataattaagctacactatctactttctctgtatttttgtggtctttctgcaagatcgatcaggatggaacacttaattaccacagtttccccctctcatgcaacaatgtagtaccaactagctagttctttttcctaagtgaaaatgtgtgttatgtgatgtataatgatctatgttgatgttgtattcacaaaaataaaataacaataatcaatccgatcgagtg

SEQ ID NO: 941 - protein, 280 aa, Glycine max
  misc_feature: Ceres Clone ID no. 1364258
  misc_feature (1)..(280): Bit score of 482.4 for hmm based on sequences of FIGURE 8.
  misc_feature (17)..(184): Pfam Name: adh_short Pfam Description: short chain dehydrogenase
  misc_feature: Functional Homolog Of SEQ ID NO. 1012
MIKSSSMASIAKMLEGKVAIITGGASGIGAATAKLFVQHGAKVIIADVQDELGQFHCKTLGTTNIHYVHCDVTSDSDVKNVVEFAVSKYGKLDIMYNNAGISGDSNRSITTSDNEGFKNVFGVNVYGAFLGAKHAARVMIPAKRGVILFTSSVASLLGGETTHAYAVSKHAVVGLMKNLCVELGEHGIRVNCVCPGGIPTPMLNNALKMNKKETQEVLCKVAVLKGTVLEAEDIAKAAVYLCSDEAKFVSGVNFVLDGGYSITNNSFTSALNALINNNHA

SEQ ID NO: 942 - DNA, 1000 bp, Gossypium hirsutum
  misc_feature: Ceres Clone ID no. 100066601
  misc_feature: Encodes the peptide sequence at SEQ ID NO. 943
cagcctgttagctttctccaaatgaccatgcctgctcaagtgattcccgacaagacccttcaaggtctccatggtttgggtagagaaaacaattcttctcctcaccctagaaggttggaagggaaagttgctattgtgacgggaggagcaagagggattggggaggcaacagtgaggctttttgcaaggcatggtgctaaggtagtgatcgcagatgtggaagacacgcttggaactgcgttggctaattctttgtctccttgtgtcacttttgttcattgtgatgttagcctggaagaagacattgagaatttagtaagttcaacagtttcccgatatgggcggcttgatatcctttttaacaatgctggggtgcttgggaatcagagaaagcataaaagcattgttgatttcgacgtggatgagttcgataatataatgagagtgaacgtgaggggaatggcgctgggaatcaagcatgctgcacgtgcaatgattccccgaggtggtgggtgcatcatttcaacagccagtgttgctggagtgatgggtggccttggtccacatgcttacacggcttcgaaacacgccattgttggattgacaaagaacgcggcttgtgaactagggcggtatgggattagagtgaactgcatttctccattcggtgtggctacacctatgcttgtgaatgcatggagaagccacgacgatgaagaagaggaaaccggctttaactttgggattccatgccaacaagaaacggagaagacggaggagtttgtgagagggcttgccaatttgaaaggtccaatactcagggctaaagacatagctgaggctgctttatatcttgctggcgatgaatctaaatatgtaagtgggcataatcttgtagtggatggtggagtcacaacatcaagaaattgtgttggcttgtaaccccattattaaccctaattgtaaattttcgattaaataaatttatttttctccattt

SEQ ID NO: 943 - protein, 306 aa, Gossypium hirsutum
  misc_feature: Ceres Clone ID no. 100066601
  misc_feature (1)..(306): Bit score of 473.1 for hmm based on sequences of FIGURE 8.
  misc_feature (35)..(203): Pfam Name: adh_short Pfam Description: short chain dehydrogenase
  misc_feature: Functional Homolog Of SEQ ID NO. 1012
MTMPAQVIPDKTLQGLHGLGRENNSSPHPRRLEGKVAIVTGGARGIGEATVRLFARHGAKVVIADVEDTLGTALANSLSPCVTFVHCDVSLEEDIENLVSSTVSRYGRLDILFNNAGVLGNQRKHKSIVDFDVDEFDNIMRVNVRGMALGIKHAARAMIPRGGGCIISTASVAGVMGGLGPHAYTASKHAIVGLTKNAACELGRYGIRVNCISPFGVATPMLVNAWRSHDDEEEETGFNFGIPCQQETEKTEEFVRGLANLKGPILRAKDIAEAALYLAGDESKYVSGHNLVVDGGVTTSRNCVGL

SEQ ID NO: 944 - protein, 147 aa, Musa acuminata
  misc_feature: Ceres CLONE ID no.1748922
  misc_feature: Bit score of 336.9 for HMM based on sequences of FIGURE 7.
  misc_feature (11)..(35): Pfam Name: zf-A20 Pfam Description: A20-like zinc finger
  misc_feature (88)..(128): Pfam Name: zf-AN1 Pfam Description: AN1-like Zinc finger
  misc_feature: Functional Homolog Of Ceres SEEDLINE ID no. ME04477 at SEQ ID NO. 742
MAEEQRCQEGHRLCANNCGFFGSPATLNLCSKCYRDHRLKEEQERQQQPASSAAASAMLTVAKSFPASSPAVVVVDEEVSGASVPSRCARCRKRVGLTGFQCRCGATYCGVHRYAEQHDCTFDFKAAGRATIARANPVVKADKLHKI

SEQ ID NO: 945 - protein, 359 aa, Zea mays; identical to SEQ ID NO: 348
  misc_feature: Public GI ID no. 194705596
  misc_feature (1)..(359): Bit score of 414.2 for hmm based on sequences of FIGURE 11.
  misc_feature (38)..(205): Pfam Name: HSF_DNA-bind Pfam Description: HSF-type DNA-binding
  misc_feature: Functional Homolog Of SEQ ID NO. 364

SEQ ID NO: 946 - DNA, 1209 bp, Panicum virgatum
  misc_feature: Ceres Clone ID no. 1803957
  misc_feature: Encodes the peptide sequence at SEQ ID NO. 947
tggctgacctttcctgcccaaggagaagctaagcttagcgcaagtacggcacggcaccgcgaggcagcagtatgttccgagccgcgtggagtgttctccttctcgggggcaagagctcggccatgtccgccgccgtcagccgcttctccgcggcggccgcctcgcagaggctggccggaaaggtggcggtgatcactggcggcgcaagcggcatcggcaaggcgacggccgccgagttcgtcaggaacggcgcgagggtcgtcctcgccgacgtccaggacgaccttggccacgccgccgccgcggacctcggcgcggacgcagtggtctacacccgctgcgacgtcaccgacgaggcgcaggtcgctgccgccgtagacctcgccgtcgcgcgccacggccgcctcgacgtcgtcttcaacaacgccgggatcggcggcaacctggcgccggtccccgtgggcgccctggacatggacgacttcgaccgcgtcatggcggtcaacgcccgcgcgatggtggccggcgtcaagcacgccgcgcgcgtcatggtgccccgccgcgccggcagcatcatctgcacggctagcaccgcgggcgtggtgggcggcgtggcgctggcgccgtacagcgtgtccaaggccgccgtggttgggctggtgcgcgccgtggccggcgagctggcgcgctctggcgtgcgggtcaacgccatctcgcccaactacatcccgacgccgctggtgatggccgccatggccgagtggtaccccgggatgggcgtcgaggagcgcaggcgggtcgtggagagggacatgaacgagatggacgggccggtgctggaggtggaggacgtggcgcgggcggcgttgtacctcgcgtccgacgagtccaagtacgtcaacggccacaacctcgtcgtcgacggcgggttcacggtggggaaggcgcccaacatgccgaaacctgcacagtgaactcgttgccaagagagatgacatcatgcatggcttcgcttgttcgtctctgatttgttcttcccgttattgggattggaaaacatggttcgctccggtccttcattgttaacggcttgtcgtccataaaattactctgtgtcctccattggtccataatgttccaaatgtatttttgtaataacacataataacgagcattttccataaattttatgagtgatatattatccat

SEQ ID NO: 947 - protein, 300 aa, Panicum virgatum
  misc_feature: Ceres Clone ID no. 1803957
  misc_feature (1)..(300): Bit score of 338.0 for hmm based on sequences of FIGURE 8.
  misc_feature (37)..(205): Pfam Name: adh_short Pfam Description: short chain dehydrogenase
  misc_feature: Functional Homolog Of SEQ ID NO. 1012
MFRAAWSVLLLGGKSSAMSAAVSRFSAAAASQRLAGKVAVITGGASGIGKATAAEFVRNGARVVLADVQDDLGHAAAADLGADAVVYTRCDVTDEAQVAAAVDLAVARHGRLDVVFNNAGIGGNLAPVPVGALDMDDFDRVMAVNARAMVAGVKHAARVMVPRRAGSIICTASTAGVVGGVALAPYSVSKAAVVGLVRAVAGELARSGVRVNAISPNYIPTPLVMAAMAEWYPGMGVEERRRVVERDMNEMDGPVLEVEDVARAALYLASDESKYVNGHNLVVDGGFTVGKAPNMPKPAQ

SEQ ID NO: 948 - DNA, 1184 bp, Zea mays
  misc_feature: Ceres Clone ID no. 100811930
  misc_feature: Encodes the peptide sequence at SEQ ID NO. 949
gaagtcgagaacaagcatccatcctagctcactcttccacctgtctttctcagcctctctctattcctcttcactctctcgaatagatagagagacccgaggtagagcaagacctcgatcaacgagtgaagcaaagggcagcatgatgcaccggcttgtcgtcgaagctaggagaagagcagccccggtggcgatggccgccggcggggtggcgggcggcgagcggtggatgtcgtcgtcggcagccagcaaaggaaggctagtagggaagattgcgctgatcaccggaggcgcgagcgggctgggcaaggccgcggcccgcgagttcatcgaggaaggcgcgggggccgtagtcctcgcggacatcaactccaagctgggcctcgagacggcccacgagctgggcccggacgcccacttcgtgcactgcgacgtggccgtcgaggacagcgtcgccgcggccgtggacgccgccgtggcgcgccacggccggctggacgtcatgctcaacagcgccggcgtagtgggcccgctgaccccaggcacgtcgcgggtcgccagcctggacctggcgcagttcgactccgtcatgtccgtgaacgtgcgcgggacgctggccgggatcaagcacgccgcgcgcgccatgctggcggcggcgcccgcgggggcaggaggaggaggaggaggagcaggagggtcgatcctctgcatggcgagcgtcagcggcatcctcggcgggctgggcacgtacctgtactcggtgtccaagttcgccatcgcggggatcgtcaaggccgcggcggccgagctgtcgcgcctcggcgtccgcgtcaactgcatctcgccgtacgcggtgcccacgccgatggtgctgggccagttctccgcgatgctgggcggggcagccgacgaggcgcaggtggcggccatcgtcaggggcctcggggagctcaggggcgccacctgcgaggccgtcgacatcgccagggccgccgtgtacctggcctccgacgacgccaagtacgtgtctggccacaaccttgtggtcgacggtggcttcacgagctacaagcacatgaacctgcccttccctaccaagccacatgagtgacttaattgccagaagcttgtgattcaggtgtcattctgctactgtttgatttgtacaaaactgcacctaaccg

SEQ ID NO: 949 - protein, 322 aa, Zea mays
  misc_feature: Ceres Clone ID no. 100811930
  misc_feature (1)..(322): Bit score of 310.9 for hmm based on sequences of FIGURE 8.
  misc_feature (43)..(224): Pfam Name: adh_short Pfam Description: short chain dehydrogenase
  misc_feature: Functional Homolog Of SEQ ID NO. 1012
MMHRLVVEARRRAAPVAMAAGGVAGGERWMSSSAASKGRLVGKIALITGGASGLGKAAAREFIEEGAGAVVLADINSKLGLETAHELGPDAHFVHCDVAVEDSVAAAVDAAVARHGRLDVMLNSAGVVGPLTPGTSRVASLDLAQFDSVMSVNVRGTLAGIKHAARAMLAAAPAGAGGGGGGAGGSILCMASVSGILGGLGTYLYSVSKFAIAGIVKAAAAELSRLGVRVNCISPYAVPTPMVLGQFSAMLGGAADEAQVAAIVRGLGELRGATCEAVDIARAAVYLASDDAKYVSGHNLVVDGGFTSYKHMNLPFPTKPHE

SEQ ID NO: 950 - DNA, 1004 bp, Arabidopsis thaliana
  misc_feature: Ceres Clone ID no. 9683
  misc_feature: Encodes the peptide sequence at SEQ ID NO. 951
attcaatttttggtggtcttttcaaaagtggaaatacaacaaaacaatgtcgggacttagaagattggatggcaagatcgcaattataacaggcggagctagtgggattggagctgaagcggttaggttgttcacggaccatggagctaaagtggtcatcgtggacatacaagaagagcttggccaaaacctcgccgtttcgatagggctagacaaagcaagtttttaccgttgtaatgtaaccgacgagacggatgtcgagaacgccgttaagttcaccgttgaaaaacacggaaagcttgacgttctgtttagtaacgccggggtcttggaagcgtttggaagcgttcttgatttggatcttgaggcgtttgatcgaacgatggcggttaacgttcgcggtgcggctgcgtttatcaaacacgcggcacgttcgatggtggctagtggtactcgtggctccattgtatgtacgacgagtattgcggcagagataggtggtccgggacctcatagttacacggcttctaagcacgcgcttctcgggctgatccgatcagcgtgtgctggactggggcagtacggtattagagtcaacggtgttgcaccgtatggggttgccactgggatgactagcgcctacaatgaggaagcggtgaagatgcttgaagaatatggtgaagccctagggaatctcaaaggtgtggtgcttaaagctcgccacatcgcagaagcagctttgtttttggcttctgatgattcggtttatattagcggtcagaatctggtggttgatggtggttttagcgtcgttaagctcatgagcacgtgagaaacaactaaaaaatgagggcatagactctcttgacactttcattttatttcttgaataaaaattgaatttataagtactttcgatcattgtgttgtatgttaggctcttgagtttatataaaccttgagtttaataatttactttttcttttagtttctcaattctatat

SEQ ID NO: 951 - protein, 261 aa, Arabidopsis thaliana
  misc_feature: Ceres Clone ID no. 9683
  misc_feature (1)..(261): Bit score of 355.0 for hmm based on sequences of FIGURE 8.
  misc_feature (10)..(177): Pfam Name: adh_short Pfam Description: short chain dehydrogenase
  misc_feature: Functional Homolog Of SEQ ID NO. 1012
MSGLRRLDGKIAIITGGASGIGAEAVRLFTDHGAKVVIVDIQEELGQNLAVSIGLDKASFYRCNVTDETDVENAVKFTVEKHGKLDVLFSNAGVLEAFGSVLDLDLEAFDRTMAVNVRGAAAFIKHAARSMVASGTRGSIVCTTSIAAEIGGPGPHSYTASKHALLGLIRSACAGLGQYGIRVNGVAPYGVATGMTSAYNEEAVKMLEEYGEALGNLKGVVLKARHIAEAALFLASDDSVYISGQNLVVDGGFSVVKLMST

SEQ ID NO: 952 - protein, 267 aa, Vitis vinifera
  misc_feature: Public GI ID no. 157346155
  misc_feature (1)..(267): Bit score of 640.4 for hmm based on sequences of FIGURE 8.
  misc_feature (9)..(176): Pfam Name: adh_short Pfam Description: short chain dehydrogenase
  misc_feature: Functional Homolog Of SEQ ID NO. 1012
MLLCRLEGKVALITGGASGIGKCTAETFTQHGAKVVIADIQDELGHSVIEALGQTNASYVHCDVTDESQIKAAVDKTAATHGKLDIMFNNAGIVNNYKPRIMDNEKADFERVLSINVTGVFLGMKHAARVMVPAKSGSIISTASVSSNVGAAATHAYCCSKHAVLGLTRNAAIELGQFGIRVNCLSPYALATPLATNFLNLTAEELETAMNATANLKGVTLKAQDVANAALYLASDESRYVSGHNLFIDGGFTVANPSFHLFQYPDS

SEQ ID NO: 953 - protein, 173 aa, Prunus armeniaca
  misc_feature: Public GI ID no.5031281
  misc_feature: Bit score of 374.5 for HMM based on sequences of FIGURE 7.
  misc_feature (114)..(154): Pfam Name: zf-AN1 Pfam Description: AN1-like Zinc finger
  misc_feature (15)..(39): Pfam Name: zf-A20 Pfam Description: A20-like zinc finger
  misc_feature: Functional Homolog Of Ceres SEEDLINE ID no. ME04477 at SEQ ID NO. 742
MEHEETGCQPHPEGPILCVNNCGFFGSVATRNMCSKCHKDMMLKEEQAKLAASSFGNIVNGTSNSNGNEPVVAAGVDVQAHLVEPKTISLQPSFSFGSGSGGSGEAKPEGPKRCGTCNKRVGLTGFNCRCGHLFCAVHRYSDKHDCPYDYHTAARDVIAKANPVVKADKLEKI

SEQ ID NO: 954 - DNA, 999 bp, Panicum virgatum
  misc_feature: Ceres CLONE ID no.1775820
  misc_feature: Encodes the peptide sequence at SEQ ID NO 955
atcgccagcgcgcgcgccggccgatctgggggcgggctccgctccacccgaggctcgccgttgacggggtccgcgtccatcggtagcaatggcacaagagagctggaaacaagagtccgaggagactagagtccacgcgcctgaggcccctattctctgcataaacaactgtggtttctttggcagcagcatgacgaacaatatgtgctcgaagtgctatagggacttcatcaagttgatggaagctcctgtggtggaaaagaaggtgaccacatcagcatcttcttccacagcaccactggagacaaagcgagatgatgcgcctgccgctgctgccactgaagctgtggctgagaagcaagcagagcaagagcccccaaagccacccagcaaccggtgtctgacttgccgcaagaaggtcgggctgaccggcttcctctgccgttgcggggacaccttctgctccacgcaccgctacaccgactcccaccagtgcacctttgactataagaaggtggcacgggagcagatagccaagcagaatccagttgtgatggccgagaagataaacaagatctaatgaatggttgtgaagggattcatgcctgggttcctgagtcctcaagttcactataatcgataggttccttcgggtggtggtctgggttagcgtggtagtagggggtctcaattgtgtctatccttctcctttatcatggttccattctctgccggaaagatgcagtggttttgcgtcgtcacttcctctggaagtagtttaagtcgagaagataagattgcacatcaggtattgcttattctggtcctggagggccaagtgttgtatcgacatgtcattggttttgtatcgttgtatgttatcacgtgtgctggaaatcacagcaagtatgaagcttatctgatcctgctaccatcatgtttatgtgatcagatgaagttatagataagcatacatatcaaaaaaaaaaaaaaaaaaaa

SEQ ID NO: 955 - protein, 163 aa, Panicum virgatum
  misc_feature: Ceres CLONE ID no.1775820
  misc_feature: Bit score of 343.8 for HMM based on sequences of FIGURE 7.
  misc_feature (104)..(144): Pfam Name: zf-AN1 Pfam Description: AN1-like Zinc finger
  misc_feature (21)..(45): Pfam Name: zf-A20 Pfam Description: A20-like zinc finger
  misc_feature: Functional Homolog Of Ceres SEEDLINE ID no. ME04477 at SEQ ID NO. 742
MAQESWKQESEETRVHAPEAPILCINNCGFFGSSMTNNMCSKCYRDFIKLMEAPVVEKKVTTSASSSTAPLETKRDDAPAAAATEAVAEKQAEQEPPKPPSNRCLTCRKKVGLTGFLCRCGDTFCSTHRYTDSHQCTFDYKKVAREQIAKQNPVVMAEKINKI

SEQ ID NO: 956 - DNA, 960 bp, Panicum virgatum
  misc_feature: Ceres CLONE ID no.1787151
  misc_feature: Encodes the peptide sequence at SEQ ID NO 957
attctccgcggggggtaagggaaaggtcgcgtggcgtctcgcccacagtccatcggtagcaatggcacaagagagctggaaacaagagtccgaggagactagagtccacgcccctgaggcccctattctctgcataaacaactgtggtttctttggcagcagcatgacgaacaatatgtgctcgaagtgctatagggacttcatcaagttgatggaagctcctgtggtggagaagaaggtgaccacatcagcatcttcttccacagcaccactggagacaaagcgagatgatgcgcctgccgctgctgccactgaagctgtggctgagaagcaagcagagcaagagcccccaaagccacccagcaaccggtgtctgacttgccgcaagaaggtcgggctgaccggcttcctctgccgttgcgggggcaccttctgctccacgcaccgctacaccgactcccaccagtgcacctttgactataagaaggtggcacgggagcagatagccaagcagaatccagttgtgatggccgagaagataaacaagatctaatgaatggttgtgaagggattcatgcctgggttcctgagtcctcaagttcactatgatcgataggttccttagggtggtggtctgggttagcgtggtagtagggggtctcaattgtgtctatccttctcctttatcatggttccattctctgccggaaagatgcagtggttttgcgtcgtcacttcctctggaagtagtttaagtcgagaagataagattgcacatcaggtattgcttattctggtcctggagggccaagtgttgtatcaacatgtcattggttttgtatcgttgtatgttatcacgtgtgctggaaatcacagcaagtatgaagcttatctgatcctgctaccatcatgtttatgtgatcagatgaagttatagacaaaaaaaaaaaaaaaaaaaaa

SEQ ID NO: 957 - protein, 163 aa, Panicum virgatum
  misc_feature: Ceres CLONE ID no.1787151
  misc_feature: Bit score of 342.9 for HMM based on sequences of FIGURE 7.
  misc_feature (104)..(144): Pfam Name: zf-AN1 Pfam Description: AN1-like Zinc finger
  misc_feature (21)..(45): Pfam Name: zf-A20 Pfam Description: A20-like zinc finger
  misc_feature: Functional Homolog Of Ceres SEEDLINE ID no. ME04477 at SEQ ID NO. 742
MAQESWKQESEETRVHAPEAPILCINNCGFFGSSMTNNMCSKCYRDFIKLMEAPVVEKKVTTSASSSTAPLETKRDDAPAAAATEAVAEKQAEQEPPKPPSNRCLTCRKKVGLTGFLCRCGGTFCSTHRYTDSHQCTFDYKKVAREQIAKQNPVVMAEKINKI

SEQ ID NO: 958 - protein, 304 aa, Picea sitchensis
  misc_feature: Public GI ID no. 116784890
  misc_feature (1)..(304): Bit score of 489.5 for hmm based on sequences of FIGURE 8.
  misc_feature (28)..(195): Pfam Name: adh_short Pfam Description: short chain dehydrogenase
  misc_feature: Functional Homolog Of SEQ ID NO. 1012
MSNEEFNAAASSVGNLSFNGSERRLKGKVAIITGGASGIGEAIVRLFTKHGAKVILADIADEAGRNLAGSLSPPATYVHCDVSKEQDVRAAVDLAMEKHGQLDIMYNNAGTIEFVAVESVAEYEMLQFDRVMSVNVRGAMLGIKHAARVMIPRKKGCIISTASVAGILGGLTPYAYTASKHAILGLTKNGAAELGKYGIRVNTVSPSGVATALLVNYNKQGNGSVVSEDDKAAVEAYCTSIGNLEGATLRAEDIAEAGLYLASDEAKYVSGHNLVVDGGFSVVNHSWKLYRKKQESLTTSTSLG

SEQ ID NO: 959 - protein, 278 aa, Dysosma versipellis
  misc_feature: Public GI ID no. 182260552
  misc_feature (1)..(278): Bit score of 469.1 for hmm based on sequences of FIGURE 8.
  misc_feature (17)..(186): Pfam Name: adh_short Pfam Description: short chain dehydrogenase
  misc_feature: Functional Homolog Of SEQ ID NO. 1012
MGFTSTSASSTNRLQDKVAIITGGAGGIGETTAKLFVRYGAKVVIADISDDHGQKVCKNIGSPDVISFVHCDVTEDEDVRNLVDATIAKHGKLDIMFGNVGVLGTTPYSILEAGNEDFKRVMDINVYGAFLVAKHAARVMIPAKKGSIVSTASISSFTAGEGVSHVYTATKHAVLGLTTSLCTELGQYGVRVNCVSPYIVASPLLTDVFRVDSSRVEELAHQAANLKGTLLRAEDVADAVAYLAGDESKYVSGLNLVIDGGYTRTNPAFPTALKHGLA

SEQ ID NO: 960 - protein, 295 aa, Populus balsamifera subsp. trichocarpa
  misc_feature: Public GI ID no. 118484640
  misc_feature (1)..(295): Bit score of 399.3 for hmm based on sequences of FIGURE 8.
  misc_feature (36)..(202): Pfam Name: adh_short Pfam Description: short chain dehydrogenase
  misc_feature: Functional Homolog Of SEQ ID NO. 1012
MFKIGFRRASISRSVSLAQVFNKGFSSQPGSKLEGKVALITGAASGIGKATAAKFINHGARVVIADIQHQLGQETANELGPDATFISCDVTKESDVSGAVDFAISKYNQLDILYNNAGVACKSPHSIVDLDLAVFDRIMNINVRGVMAGVKHASRVMIPRRSGAILCTASITGLMGGLAQHTYSVSKFAVAGIVKSLAAELCKHGIRINCISPFAIPTPFVMEEMRQIYPGADDEKLVEILYRTGTLEGANCEPNDIANAALYLASDDAKYVSGHNLVVDGGFTSFKNPMLPASI

SEQ ID NO: 961 - protein, 329 aa, Physcomitrella patens subsp. patens
  misc_feature: Public GI ID no. 168001260
  misc_feature (1)..(329): Bit score of 301.7 for hmm based on sequences of FIGURE 8.
  misc_feature (60)..(225): Pfam Name: adh_short Pfam Description: short chain dehydrogenase
  misc_feature: Functional Homolog Of SEQ ID NO. 1012
MVYSMWHLRTCLRQNGLSNVFKKARTVTPDVYSSPRYCHRSSLHRESSTCPSWGDRFAGKVVVVTGGASGIGEATARLFAKNGAYVVIADINTEGGSQLSSELGSQAQFVHCDVRKERDVASLVDEAVRWKGKLDVYFSNAGFVGALGSIDELNLDDFDETLAVNLRGAVVGIKHATRVMKPVKSGAIVCTGSTASQMGGLGPHTYCVSKTALKGLVRSTALELRSYGIRVNMVSPDATATPMFQRVMEDSTGEPYTLEQIKERMAKKALLPNRPLTSLDVANAVLFLCSDEAGYISGHNLLLDAARTVGLPIPPGFSHWFEGYSPILK

SEQ ID NO: 962 - protein, 260 aa, Arabidopsis thaliana
  misc_feature: Public GI ID no. 186510565
  misc_feature (1)..(260): Bit score of 350.2 for hmm based on sequences of FIGURE 8.
  misc_feature (9)..(176): Pfam Name: adh_short Pfam Description: short chain dehydrogenase
  misc_feature: Functional Homolog Of SEQ ID NO. 1012
MSGLRLDGKIAIITGGASGIGAEAVRLFTDHGAKVVIVDIQEELGQNLAVSIGLDKASFYRCNVTDETDVENAVKFTVEKHGKLDVLFSNAGVLEAFGSVLDLDLEAFDRTMAVNVRGAAAFIKHAARSMVASGTRGSIVCTTSIAAEIGGPGPHSYTASKHALLGLIRSACAGLGQYGIRVNGVAPYGVATGMTSAYNEEAVKMLEEYGEALGNLKGVVLKARHIAEAALFLASDDSVYISGQNLVVDGGFSVVKLMTT

SEQ ID NO: 963 - protein, 265 aa, Mentha haplocalyx var. piperascens
  misc_feature: Public GI ID no. 148887811
  misc_feature (1)..(265): Bit score of 270.5 for hmm based on sequences of FIGURE 8.
  misc_feature (10)..(179): Pfam Name: adh_short Pfam Description: short chain dehydrogenase
  misc_feature: Functional Homolog Of SEQ ID NO. 1012
MASVKKLAGKVAIVTGGASGIGEVTARLFAERGARAVVIADMQPEKGGTVAESIGGRRCSYVHCDITDEEQVRSVVDWTASTYGGVDVMFCNAGTASATAQTVLDLDLTQFDRVMRVNARGTAACVKQAARKMVELGRGGAIICTASATAHHAGPNLTDYIMSKCGVLGLVRSASLQLGVHGIRVNSVSPTALATPLTATIGLRTAADVESFYGQVTSLKGVAITAEHVAEAVAFLASDEAAFVTGHDLAVDGGLQCLPFVAVAK

SEQ ID NO: 964 - protein, 265 aa, Mentha x piperita
  misc_feature: Public GI ID no. 158979021
  misc_feature (1)..(265): Bit score of 270.0 for hmm based on sequences of FIGURE 8.
  misc_feature (10)..(179): Pfam Name: adh_short Pfam Description: short chain dehydrogenase
  misc_feature: Functional Homolog Of SEQ ID NO. 1012
MASVKKLAGKVAIVTGGASGIGEVIARLFAERGARAVVIADMQPEKGGTVAESIGGRRCSYVHCDITDEEQVRSVVDWTAATYGGVDVMFCNAGTASATAQTVLDLDLAQFDRVMRVNARGTAACVKQAARKMVELGRGGAIICTASATANHAGPNLTDYIMSKRGVLGLVRSASLQLGVHGIRVNSVSPTALATPLTATIGLRTAADVESFYGQVTSLKGVAITAEHVAEAVAFLASDEAAFVTGHDLAVDGGLQCLPFVAVAK

SEQ ID NO: 965 - DNA, 507 bp, Brassica napus
  misc_feature: Ceres Clone ID no. 965131
  misc_feature: Encodes the peptide sequence at SEQ ID NO. 966
acaataattctctttcactcgttcgacgagaaaaatcaaaatcaagagaagaaaaaagataatctaaaagggttcgatttgccacgcaatgtctggagaagaagaagagaacgccgccgagctcaagatcggcgacgagtttttgaaggcgaagtgcttaatgaactgtgaagtgtcgttgatcctcgagcacaagtacgaacagcttcagcacgtctccgaggatcctatgaatcaagtttctcaagtgtttgagaagtcgttgcagtatgtgaagcgatttagccgctacaagaatccagatgctgttcgacaagttcgagaaatcctgagtagacatcagctcactgagtttgagctttgtgttcttggcaatctctgtcctgaaactgctgaagaagcagtggctatggttccctccctcaagacaaaaggaagagctcatagtgatgaagcaattgagaagatgctcaatgatctctcacttgtcaagagatttgagtagtt

SEQ ID NO: 966 - protein, 138 aa, Brassica napus
  misc_feature: Ceres Clone ID no. 965131
  misc_feature (1)..(138): Bit score of 372.0 for hmm based on sequences of FIGURE 1.
  misc_feature (19)..(135): Pfam Name: RNA_pol_Rpb4 Pfam Description: RNA polymerase Rpb4
  misc_feature: Functional Homolog Of SEQ ID NO. 442
MSGEEEENAAELKIGDEFLKAKCLMNCEVSLILEHKYEQLQHVSEDPMNQVSQVFEKSLQYVKRFSRYKNPDAVRQVREILSRHQLTEFELCVLGNLCPETAEEAVAMVPSLKTKGRAHSDEAIEKMLNDLSLVKRFE

SEQ ID NO: 967 - DNA, 487 bp, Glycine max
  misc_feature: Ceres Clone ID no. 1050944
  misc_feature: Encodes the peptide sequence at SEQ ID NO. 968
atctctcgttcgattcttggcattccacttctcgccctcgttctttttttgcgttttcttcttcttcttcttcttcttcttcttcttcttctcactttttacctaagattttgtggaacatgtccggggaagaggaagaaaacgccgcagagctcaaaattggagacgagtttttgaaggcaaagtgcttaatgaactgtgaagtttcattgattcttgagcacaagtatgagcagcttcaacagacatctgatgatcccatgaatcaaatttctcaggtatttgaaaagtcactgcagtatgtgaaacgtttcagtcgctataaaaatcctgatgctgtcagacaagttcgagaaattctcgcaagatatcaattggctgagtttgagttgtgtgtccttggcaacctttgcccagaaactgtggaggaagctattgctatggttccatctatcaagtccagaggacgagctcaggatgatgaagc

SEQ ID NO: 968 - protein, 122 aa, Glycine max
  misc_feature: Ceres Clone ID no. 1050944
  misc_feature (1)..(122): Bit score of 305.5 for hmm based on sequences of FIGURE 1.
  misc_feature (19)..(122): Pfam Name: RNA_pol_Rpb4 Pfam Description: RNA polymerase Rpb4
  misc_feature: Functional Homolog Of SEQ ID NO. 442
MSGEEEENAAELKIGDEFLKAKCLMNCEVSLILEHKYEQLQQTSDDPMNQISQVFEKSLQYVKRFSRYKNPDAVRQVREILARYQLAEFELCVLGNLCPETVEEAIAMVPSIKSRGRAQDDE

SEQ ID NO: 969 - protein, 138 aa, Elaeis guineensis
  misc_feature: Public GI ID no. 192910802
  misc_feature (1)..(138): Bit score of 363.5 for hmm based on sequences of FIGURE 1.
  misc_feature (19)..(135): Pfam Name: RNA_pol_Rpb4 Pfam Description: RNA polymerase Rpb4
  misc_feature: Functional Homolog Of SEQ ID NO. 442
MSGEEEENAAELKIGEEFLKAKCLMNCEVALILDRKYEQLQQLSDDPTNQISQVFEKSMQYVKRFSRYKNQDAVRQVREILSRYRLAEFELCVLGNLCPETVEEAIAMVPSIKSKGRIHEDDAIEKMLNDLSLIKKFE

SEQ ID NO: 970 - protein, 142 aa, Physcomitrella patens subsp. patens
  misc_feature: Public GI ID no. 168028875
  misc_feature (1)..(142): Bit score of 281.8 for hmm based on sequences of FIGURE 1.
  misc_feature (24)..(139): Pfam Name: RNA_pol_Rpb4 Pfam Description: RNA polymerase Rpb4
  misc_feature: Functional Homolog Of SEQ ID NO. 442
MASRSGQPVEEEDASELKLGEDFVKAKCLMNAEVALVLQRKYEQLQQLADDPSSQISQVFERSLQYVRRFSRYQNPDAVKQVREVLTRNQLHEFEVCVIGNLCPETVEEAKALVPSITKRGRMDEEKIETMLTDLATIKKFE

SEQ ID NO: 971 - protein, 349 aa, Zea mays
  misc_feature: Public GI ID no. 194704162
  misc_feature (1)..(349): Bit score of 834.1 for hmm based on sequences of FIGURE 4.
  misc_feature (76)..(346): Pfam Name: Sulfotransfer_1 Pfam Description: Sulfotransferase domain
  misc_feature: Functional Homolog Of SEQ ID NO. 590
MSSSSVQQTAFPEQEADAEGETNPELYQHFANLVSSLPSSKGLSNNKFYRHGQGWHCSEVGIVGAMVTDACFSARPSDVIIATLPKSGTTWMKSLLYATVHRRERPVVGAAAADQHPLNSWGPHDLIKFFEYQLYTRDRVPDLDRLPDPRLFATHVPFVSLPSSVVATPGCKIVYVCRDPKDHLVSLWDFVNKYFRVKDGLEPLSVEAAAELFCAGLTPFGPYWDHVLGYWRAHRADPDKVLFFRYEEMQRDPAAHVRRLAEFVGLPFSSEEEDGGVVDAVVGLCSFERMRGMAPTKGGRTEFPIGVVPNSSFFRQGVVGDWVNHLSPEMARRIDAITADKFRGSGLVV

SEQ ID NO: 972 - DNA, 770 bp, Panicum virgatum
  misc_feature: Ceres CLONE ID no.1765871
  misc_feature: Encodes the peptide sequence at SEQ ID NO 973
gttggctaacaatcccattgctgcgctgcagcccatctgtagcaatggcacaggagagctggaaacaggagtccgaggagactggagtccatgcgcctgaggccccaattctgtgcataaacaactgtgttttcttcggcagcagcatgacaaacaatatgtgctcgaagtgctacagggacttcatcaagttgatggaagcccctgtggttgagaagaaggtgatcacggtggcatcttcttctgcggcaccaatggagacagcaaatcaagatgatgtgcctgcagctgctgccgctgaagctgttgcggagaagcaagcagagcaggagccgccaaagccgcccagcaaccggtgcctgacctgccgcaagaaggttgggctgaccggctttctctgccgctgtgggggcaccttctgctccatgcaccgctacaccgactcccaccagtgcacctttgactacaagaaggtggcacgggagcagattgccaagcaaaatccagttgtgatggcagagaagatcaacaagatatgatgcatggtcgtgtgcagggattgctgaattcatgcctgagttcctgagtcctcaagttcactccaaacgataggttccttcaggtggtggtctgggttagcgtggtagggggtctcaattgtgtctatccttctcctttatcatggtttcattctctcgattgtgtaataatgtaaatatattcaaactgtaatttaatcatattgcttccaaaaaaaaaaaaaaaaaaaa

SEQ ID NO: 973 - protein, 164 aa, Panicum virgatum
  misc_feature: Ceres CLONE ID no.1765871
  misc_feature: Bit score of 328.4 for HMM based on sequences of FIGURE 7.
  misc_feature (105)..(145): Pfam Name: zf-AN1 Pfam Description: AN1-like Zinc finger
  misc_feature (21)..(45): Pfam Name: zf-A20 Pfam Description: A20-like zinc finger
  misc_feature: Functional Homolog Of Ceres SEEDLINE ID no. ME04477 at SEQ ID NO. 742
MAQESWKQESEETGVHAPEAPILCINNCVFFGSSMTNNMCSKCYRDFIKLMEAPVVEKKVITVASSSAAPMETANQDDVPAAAAAEAVAEKQAEQEPPKPPSNRCLTCRKKVGLTGFLCRCGGTFCSMHRYTDSHQCTFDYKKVAREQIAKQNPVVMAEKINKI

SEQ ID NO: 974 - protein, 332 aa, Vitis vinifera
  misc_feature: Public GI ID no. 157357874
  misc_feature (1)..(332): Bit score of 680.2 for hmm based on sequences of FIGURE 4.
  misc_feature (67)..(326): Pfam Name: Sulfotransfer_1 Pfam Description: Sulfotransferase domain
  misc_feature: Functional Homolog Of SEQ ID NO. 590
MSITHSTKTQSTNDEEELSDEFKELLLSLPKERGWRTSHIYLYQEFWCQPKEIQAIINFQQHFQARDSDLILVTMPKSGTTWLKAMAFAVLNRKSFSISKNHPLLTSNPHDLVPFLEYKLYANNQLPDLSMLPQPRLLATHVPFSSLPASIKNSDCRIVYWCRNPLDTFVSSWHFLMKVRPETLGPISIEEGFEMYCRGAMAFGPFWKHMLEYWNESLEPPNKMLFMKYEDAKEDPVFQLKRLANFLGVPFSFEEEREGVAEEISRLCSFENLKNLEVNQTGRSIGYFENKNLFRTGVVGDWVNHLTPSMAGQIFQIMKGKLAGSGLEFKVF

SEQ ID NO: 975 - protein, 330 aa, Populus balsamifera subsp. trichocarpa
  misc_feature: Public GI ID no. 118486287
  misc_feature (1)..(330): Bit score of 597.8 for hmm based on sequences of FIGURE 4.
  misc_feature (65)..(323): Pfam Name: Sulfotransfer_1 Pfam Description: Sulfotransferase domain
  misc_feature: Functional Homolog Of SEQ ID NO. 590
MEDTQMITGNNNSLAETDEIADLLSSLPKEKSWRLGYLYRYQGFWCPEKQIPAVIAFQKHFIAQKTDTILVTMPKSGTTWLKALAFSIMNRAKYTPSCSPLNSVNPHDLVPFFEFRLYANNQLPDLSTFPSPRMFATHVPYPSLPDSIKNSGCRIVCLCRNPFDNFISLWHFASKARHESLGPLSMEDCFDSFCNGLGGFGPFFDHVLGYWRESLERPEEVLFLTYEDMKEDINSQMKRLAEFLGCPFSLEEEADGVVEGISKLCSFSNMKDKEINKTGKSIPHFENKTLFRRGEVGDWVNYLSPEMVDRLNKIMEQKLAGSGLKFKTGL

SEQ ID NO: 976 - DNA, 1598 bp, Panicum virgatum
  misc_feature: Ceres CLONE ID no.1990071
  misc_feature: Encodes the peptide sequence at SEQ ID NO 977
gccttcgcctacctctcgacgcccaaccccaaaaagaaaaattctcctcgcggagaaaggtcgcgtgccgtctcgcccacaggttggcggcgggcttcgcgtcgaggcgcggccggttggttctggatcggatctgcgcggattggaattgggttgacccggtgggtttggtggcacagggtctgcgcgcctctgttacggaggatttgggctcgcctgtgggtattttccctttaattatttgcagatcatttgcggtggtttgttttctaggctggcactggcaggcgagacctcaacctttgtgaacagcggagggggtgaatcagtgaaggatagcgagtccgtccgcgtggttgatgaacaaactttggtggttgccggcggatgtgggagtgggttcatcctggcgccgccgggtgcacgccgcggcgtgcgtggctgcttgcttgtcgcagggctcttccatccctgcgtcacatgcgagcttcgtgccaattcgtgaagcaggcgagagatgtttgctgataaggtctcctgtggcccttgtgtagggggtggatgaagcggcgagcttcctttccgtgctcggcgtgggtarccttgattgtggccagaggtttcgtgctggccatggcaaggtctattgcttggacgtgtggataaaggtttgactgcctgaattggctgtgtgcatctacctgattgcagttccgggcactgattgcttcgcctgtatgctgctggttgcctgccttgtgctgctactacatatgcaatctgtggagcaaccaaaaagaccttggcttcatgctatgattgtgtcaagcaattgactaaccacgcccatctgttgcaatggcacacgagagctggaaacaggaatctgaggagactggagtccatgcacctgaggccccaattctgtgcataaacaactgtggtttyttcggcagcagcatgacgaacaatatgtgctcgaagtgctmcagggacttcatcaaattgwtggaaggccctgtggttgagaagaaggtgatcacggtggcatcttcttctgcggcaccaatggagacagcaaagcaagatgatgtgcctgcagctgctgccactgaagctgtgacggagaagcaagcagagcaggagcccccaaagccgcccagcaaccggtgccttacctgccgcaagaaggttgggctgactggcttcctctgccgctgcgggggccccttttgctccatgcaccgctacactgactcccaccagtgcaccttcgactacaagaaggtggcacgggagcagattgccaagcaaaatccagttgtgatggcagagaagattaacaagatatgatgcatagtcatgtgaagggatcactaaattcatgcctgggttcactccaaatgataggttccttcaggcggtggtctgggtctgggttagagtggtagctggtctcaattgtgtctatccccctttatcatggtttcattctctcgattgtgtaataatgtaaatatattcaaactgtaatttaatcctattgcttcctactacgattgatgggtttgatgggtttatcgctgatcatggctttc

SEQ ID NO: 977 - protein, 164 aa, Panicum virgatum
  misc_feature: Ceres CLONE ID no.1990071
  misc_feature: Bit score of 309.4 for HMM based on sequences of FIGURE 7.
  misc_feature (105)..(145): Pfam Name: zf-AN1 Pfam Description: AN1-like Zinc finger
  misc_feature (21)..(45): Pfam Name: zf-A20 Pfam Description: A20-like zinc finger
  misc_feature: Functional Homolog Of Ceres SEEDLINE ID no. ME04477 at SEQ ID NO. 742
  misc_feature (30)..(30): Xaa is any aa, unknown, or other
  misc_feature (44)..(44): Xaa is any aa, unknown, or other
  misc_feature (51)..(51): Xaa is any aa, unknown, or other
MAHESWKQESEETGVHAPEAPILCINNCGXFGSSMTNNMCSKCXRDFIKLXEGPVVEKKVITVASSSAAPMETAKQDDVPAAAATEAVTEKQAEQEPPKPPSNRCLTCRKKVGLTGFLCRCGGPFCSMHRYTDSHQCTFDYKKVAREQIAKQNPVVMAEKINKI

SEQ ID NO: 978 - protein, 343 aa, Vitis vinifera
  misc_feature: Public GI ID no. 157357554
  misc_feature (1)..(343): Bit score of 591.9 for hmm based on sequences of FIGURE 4.
  misc_feature (62)..(320): Pfam Name: Sulfotransfer_1 Pfam Description: Sulfotransferase domain
  misc_feature: Functional Homolog Of SEQ ID NO. 590
MEKSEVPQEEPCKDDEFQKLLLTLPEERNWDGTSLYLYQGFWCPSIAIKPVFSFQQHFQALGSDLILASTPKSGTTWLKALTFSILNRTRYTLNDSPLHTTSPHGLVPFVEFDVYLKNKSPNLMLLPSPRIFATHVPYGSLPSSIKESNCRIVYVCRNAVDQLISYWHFALKLRRGNVKPLSLDEGFEKFCHGVHSFGPFAEHVLGYWKANLDRPKNVLFLKYEDMKEDVFSHTKRLAEFLGCPFSAMEEKQGVIQEICGLCSFENLKDLEVNKSGKRPSGVPNSAFFRNGKVGDWGDHLSPSKAEYLEKLIEEKLSGSGLTLKICPKFQKEDECKPSSEMEA

SEQ ID NO: 979 - protein, 339 aa, Brassica rapa subsp. chinensis
  misc_feature: Public GI ID no. 197090699
  misc_feature (1)..(339): Bit score of 390.7 for hmm based on sequences of FIGURE 4.
  misc_feature (72)..(333): Pfam Name: Sulfotransfer_1 Pfam Description: Sulfotransferase domain
  misc_feature: Functional Homolog Of SEQ ID NO. 590
MEPTTTQNGSELELELSEFEKTQKKYQDFIASLPKSKGWRPKEILIQHGGHWWQECLLEGLLHAKDHFQARPTDFLVCSYPKTGTTWLKALTYAIVNRSRFDDATNPLLKRNPHEFVPYVEIDFAFYPTVDVLQDQKNPLFSTHIPNGSLPDSIVNSGCKMVYIWRDPKDTFISMWTFLHKEKSQEGQLASLEESFDMFCKGLSVYGPYLDHVLGYWKAYQENPERILFLRYETMRANPLPFVKRLAEFMGYGFSAEEEEKGVAENVVKLCSFETLKNLEANKGDKEREDRPAVYANSAYFRKGKVGDWANYLTPEMAARIDGLVEEKFRDTGLLEHDQ

SEQ ID NO: 980 - protein, 323 aa, Populus balsamifera subsp. trichocarpa
  misc_feature: Public GI ID no. 118486878
  misc_feature (1)..(323): Bit score of 380.6 for hmm based on sequences of FIGURE 4.
  misc_feature (63)..(321): Pfam Name: Sulfotransfer_1 Pfam Description: Sulfotransferase domain
  misc_feature: Functional Homolog Of SEQ ID NO. 590
MSDASKISESPNTKNKYEKIISNLRQDDGWKPVGKLYEYQGFWYGPSLVQNVISAQESFTPQPTDIVLCSSPKSGTAWLKALAFSIVSRNRVNDSTNPLLKKLPHEIVPFLEIELAQDSNNRNLETPFVATHIPYSSLPRSIIDSSCKIIYICRDPKDVLISHWNFDQQVSGIGSESFPLEEALEQYCKGIYPFGPYWDHVLGFWKASLEFPEKVLFVKYEDLKTDGPFHVKRMAKFMGHPFSIEEEQQGAPEKIVSMCSFENLSRLEVNKNGKYYLPDLPTFENKSFFRKGKAGDWKNYLTDGKAVKFNQIMEEKFSGSGLV

SEQ ID NO: 981 - protein, 321 aa, Hordeum vulgare
  misc_feature: Public GI ID no. 63147804
  misc_feature (1)..(321): Bit score of 272.6 for hmm based on sequences of FIGURE 4.
  misc_feature (43)..(314): Pfam Name: Sulfotransfer_1 Pfam Description: Sulfotransferase domain
  misc_feature: Functional Homolog Of SEQ ID NO. 590
MKMKSLSLQTRCPPDPMAQHGGFWFPGYIVEAMEAVALFEPRASDVLLASFPKSGTTWLKALAFAAVHRAEHPPHSPDHPLRHRNPHQCVEFLEFAFAESATTADDVFAALPSPRVLATHLPYSLLPERVTVTAEAGRIVYICRDPKDTLVSMWMFAKKCMAVAGSGTAVEEEDTFTFKEAFELFCQGQCANGPPWHHVAGYWEASQRWPDKVLFLRYEELLQDPVGNVRKLAGFMGRGFSEDEEAAGLLQQIVELCSFHALKNMKVNKSGTVYDLKNESFFRNGVAGDWTNHMTPAMAAMLDKIVHDALGLQGSGFTFRP

SEQ ID NO: 982 - DNA, 1313 bp, Panicum virgatum
  misc_feature: Ceres Clone ID no. 1819939
  misc_feature: Encodes the peptide sequence at SEQ ID NO. 983
caagctcggtggatctagagcagcacaatgaccaccaccggcgccgggaaggacgacgtcgagggcctgaagcaggcaatggcggccggcgcgggcatcgccgacctcatcccttcgctgcccctcgagacgaggtgccagccgttcctcctccgtcagctcggcggcttctggctgcccgagatgttccttcccggggtcgccgccgcgcacgcgcgcttcaagcccaggcccgacgacgtcttcctcgccagcttccccaagtccggcacgacctggctcaaggcactcaccttcgctacgctcaaccgggcccaccacccgccgtccgaccctgaccacccactccggctccaaagcccccacgactgcgtcagcttcttcgagcttcccttggccctcgctgcggccagcagcaacggcggcggcggaggggacagggaggaggaggaagaagcgttcgcggcgctcccttcgccgcgcgtgctcgccacccacctgccctaccacctcctgccggagcgcatcaccgcggagagctccggctgccgcgtcgtctacgtctgccgggactccaaggacgcgttcgtatccgcgtgggtgttcaccaagaagacagcggccgcaaaggccgccgccggcgaggccccaccgccgccgccgtacccgctcgagtcagcgttcgagctgttctgcgacggccgcagcgtcggcggcccgcagtggctgcacgtgctcgggtactgggaggcgagcctgcggcggccggacagggtgctcttccttcagtacgaggacatgctccgggacccggtgagcagcgtgaggaagcttgccgagttcttgcgctgcccgttctccggcgaggaggaggcggcgggcgcggtgggcgccgtcgtggagctctgcagcctgggcagcctccaggggtccaaggggaaccggagcggcaagacgaaggatatgagcatcgacaacgggctgttcttccggaagggcgaggcgggggactggcgcaaccacctgtcgccggagatggcggcgcggctggaccagatcgtcggcgaggcgctgcaagggtcggggctcacgttgggtggcgtcgccggcgccgcgcgcgacgacgacgacgactctgcgtgagccgccggcacgtttggcgacatgcagatgcaaatgcaggtgacgctggaactggtattcactcgcgtgattcctgagcgttttgctgagtaaatgggggtgctatgcgcacctccaaggctcagaaccagaataagtttactcaacatgcatgtatgtgcgagcgactt

SEQ ID NO: 983 - protein, 371 aa, Panicum virgatum
  misc_feature: Ceres Clone ID no. 1819939
  misc_feature (1)..(371): Bit score of 363.4 for hmm based on sequences of FIGURE 4.
  misc_feature (69)..(353): Pfam Name: Sulfotransfer_1 Pfam Description: Sulfotransferase domain
  misc_feature: Functional Homolog Of SEQ ID NO. 590
MTTTGAGKDDVEGLKQAMAAGAGIADLIPSLPLETRCQPFLLRQLGGFWLPEMFLPGVAAAHARFKPRPDDVFLASFPKSGTTWLKALTFATLNRAHHPPSDPDHPLRLQSPHDCVSFFELPLALAAASSNGGGGGDREEEEEAFAALPSPRVLATHLPYHLLPERITAESSGCRVVYVCRDSKDAFVSAWVFTKKTAAAKAAAGEAPPPPPYPLESAFELFCDGRSVGGPQWLHVLGYWEASLRRPDRVLFLQYEDMLRDPVSSVRKLAEFLRCPFSGEEEAAGAVGAVVELCSLGSLQGSKGNRSGKTKDMSIDNGLFFRKGEAGDWRNHLSPEMAARLDQIVGEALQGSGLTLGGVAGAARDDDDDSA

SEQ ID NO: 984 - DNA, 1225 bp, Zea mays
  misc_feature: Ceres Clone ID no. 1556612
  misc_feature: Encodes the peptide sequence at SEQ ID NO. 985
ctgtcagtcagtcggtggcagagacgagcaccttctccagtttttttctcagttctcactccatggccgccgcggcctgcaacccagtggctccttccgggcctgtgccgttcaaggacgtcgacgacggcagtgttccagagcacactcccaaggaggagttcggcgacctcgtggccgcgctgccgagcaggcagcagtccatcctggagctgcgcctgtaccagggcttctggctgccggagcactgggtgccggggaccatcgtgttccagcgccgcttcacgccgcgccccgacgacgtgatcctcgcgagctaccccaagtgcggcaccacgtggctgaaggcgctggccttcgccacggcggcgcgtacggcgtacccgcccggtggcgccaggcacccgctccgacggctcaacccgcacgactgcgtcccgttcatcgacgagatcttcgccagcggggaggaggcgaagctcgaggccctcccgtcgccgaggctgatgaacacgcacctgccctacgccctgctcccggcgcccgtcaccgccaccgccaccgggtgcagggtcgcgtacgtgtgcagggaccccaaggacatggtggtctcgctctggcacttcctccggcgcgccaagccggacctcttgttcgccgacacgttcgagtccgtctgcgacggcaccgtggtggtcggcccggtctgggaccacgtcctctcctactggcgtgcgagcgtggcggccccggacagggcgctcttcctcaggtacgaggacatgctgcgggaccccggcggcaacgtgcggcggctcgccgagttcatgggccgcccgttctcggccgccgaggaggccgccggcgacgtcgcggccgtcgtggagctctgcagcttcgacgagatgaaagggctggaggtgaacaggcctggtagcggcaccgcggggaggtaccgccccatgccgcgcgacgccttcttccggaagggtgtcgccggggactgggcgaaccacatgacgccggagatggcggcgcggctggacgggatcttccgtgaaaagctccaagggacggggcttatcttctcataatgcaaatgtgtatacggctcttgatttgcgtggtcatctcttctgatcttttccgtggtgtcttgtgtttacacgagatatgttagatccaaaataagtagtgatgatttaatatatacatcatatgcatc

SEQ ID NO: 985 - protein, 343 aa, Zea mays
  misc_feature: Ceres Clone ID no. 1556612
  misc_feature (1)..(343): Bit score of 360.0 for hmm based on sequences of FIGURE 4.
  misc_feature (78)..(339): Pfam Name: Sulfotransfer_1 Pfam Description: Sulfotransferase domain
  misc_feature: Functional Homolog Of SEQ ID NO. 590
MAAAACNPVAPSGPVPFKDVDDGSVPEHTPKEEFGDLVAALPSRQQSILELRLYQGFWLPEHWVPGTIVFQRRFTPRPDDVILASYPKCGTTWLKALAFATAARTAYPPGGARHPLRRLNPHDCVPFIDEIFASGEEAKLEALPSPRLMNTHLPYALLPAPVTATATGCRVAYVCRDPKDMVVSLWHFLRRAKPDLLFADTFESVCDGTVVVGPVWDHVLSYWRASVAAPDRALFLRYEDMLRDPGGNVRRLAEFMGRPFSAAEEAAGDVAAVVELCSFDEMKGLEVNRPGSGTAGRYRPMPRDAFFRKGVAGDWANHMTPEMAARLDGIFREKLQGTGLIFS

SEQ ID NO: 986 - DNA, 1320 bp, Triticum aestivum
  misc_feature: Ceres Clone ID no. 1064128
  misc_feature: Encodes the peptide sequence at SEQ ID NO. 987
atttacgattagcctagcgactcggcatggctactgtcttcccccgtgacgccggcgtctccacgccggaagccgacgaggctaagaaaatctacgatgaagcacggcgagtggtgtccacctacgagactgttcccagtcccagcggaaccctgcaggattactgccgccaccccagcggctggtgcataaccctgccgatcatggtgagctccatggtcgcagagcagcactttgaggcgcgtggcaccgacgtgctccttgttacgatgcccaagtccgggactacctggatcaaggccctcctctatgctgcggcccaccgcactgacgacacatcatcgtccatactccggcagctcgcctcccacaactcccaccagctcgttcctttcctcgaggcccaggtctacaccaaggaccagattccagacctgagctcgcttcccgcgccacggctcttcgccacgcacatcccggctgagtcgctgccaccctccgttgtggcgtccggctgcaaggtggtgtacttgtgccgggaccccaaggactgcttcgtgtctctctggcactttatgaacaagttcaccccatgggacatcgacgaggcacacggccggttctgcgagggtgtctcgttgtatgggccattttgggagcacgtgctgagctactggcgttggcacgtcgaccgaccgggtcaggtgctcttcctgacttacgaggagctcagcgccgacccgctcggccaactgaggcgcctagccgagttcattgggcgccccttcacgccgggggagcaggaggcgggagtggacagggagattgcggaggcatgtgccatgaaaagcatggtcaaccaggaggtgaaccagtccaggacgaccgaaatcgttgagatgccgattcccaacgggatcttcttccggcgaggcgtggtcggagactggaccaactacctcacgccggagatggcaggaaggatcgatgagattaccaagagcaagtttgaaggatccggcctcatgctgccgaaaacaatctcggaaatctcaaagatctagcatccctccgtcgtgtttgatgtttgaaatcgttcaccttttttttctcttgttgtaaactgcaccctgctggcactggcttggctgaataaaaaaagcttgcattgttcttgttgatcaaacgaaataccagctggcgagttgttgatgttacggaaaaggcctgcttagtcttaggtatttttcttatcggtttaattgtgatcaaatgtgtttgtactctgcttaattattaataaaaatgattgtatgcacc

SEQ ID NO: 987 - protein, 345 aa, Triticum aestivum
  misc_feature: Ceres Clone ID no. 1064128
  misc_feature (1)..(345): Bit score of 352.5 for hmm based on sequences of FIGURE 4.
  misc_feature (74)..(332): Pfam Name: Sulfotransfer_1 Pfam Description: Sulfotransferase domain
  misc_feature: Functional Homolog Of SEQ ID NO. 590
MATVFPRDAGVSTPEADEAKKIYDEARRVVSTYETVPSPSGTLQDYCRHPSGWCITLPIMVSSMVAEQHFEARGTDVLLVTMPKSGTTWIKALLYAAAHRTDDTSSSILRQLASHNSHQLVPFLEAQVYTKDQIPDLSSLPAPRLFATHIPAESLPPSVVASGCKVVYLCRDPKDCFVSLWHFMNKFTPWDIDEAHGRFCEGVSLYGPFWEHVLSYWRWHVDRPGQVLFLTYEELSADPLGQLRRLAEFIGRPFTPGEQEAGVDREIAEACAMKSMVNQEVNQSRTTEIVEMPIPNGIFFRRGVVGDWTNYLTPEMAGRIDEITKSKFEGSGLMLPKTISEISKI

SEQ ID NO: 988 - protein, 171 aa, Oryza sativa subsp. indica
  misc_feature: Public GI ID no.35187687
  misc_feature: Bit score of 382.2 for HMM based on sequences of FIGURE 7.
  misc_feature (112)..(152): Pfam Name: zf-AN1 Pfam Description: AN1-like Zinc finger
  misc_feature (14)..(38): Pfam Name: zf-A20 Pfam Description: A20-like zinc finger
  misc_feature: Functional Homolog Of Ceres SEEDLINE ID no. ME04477 at SEQ ID NO. 742
MEHKETGCQQPKGPILCINNCGFFGSAATMNMCSKCHKEMIMKQEQAKLAASSIDSIVNGGDSGKEPIIAGHAEVAVAQVEVKTLVAQPAEIAGPSEGVTVNPKGREGPNRCSTCRKRVGLTGFNCRCGNLYCAMHRYSDKHDCQFDYRTAARDAIAKANPVVKAEKLDKI

SEQ ID NO: 989 - protein, 171 aa, Oryza sativa subsp. indica
  misc_feature: Public GI ID no.125556051
  misc_feature: Bit score of 318.6 for HMM based on sequences of FIGURE 7.
  misc_feature (112)..(152): Pfam Name: zf-AN1 Pfam Description: AN1-like Zinc finger
  misc_feature (20)..(38): Pfam Name: zf-A20 Pfam Description: A20-like zinc finger
  misc_feature: Functional Homolog Of Ceres SEEDLINE ID no. ME04477 at SEQ ID NO. 742
  misc_feature (3)..(3): Xaa is any aa, unknown, or other
MEXQGDWMPAARRPDPLHHNCGFFGSAATMNMCSKCHKEMIMKQEQAKLAASSIDSIVNGGDSGKEPIIAGHAEVAVAQVEVKTLVAQPAEIAGPSEGVTVNPKGREGPNRCSTCRKRVGLTGFNCRCGNLYCATHRYSDKHDCQFDYRTAARDAIAKANPVVKAEKLDKI

SEQ ID NO: 990 - protein, 223 aa, Oryza sativa subsp. indica
  misc_feature: Public GI ID no.125561658
  misc_feature: Bit score of 386.5 for HMM based on sequences of FIGURE 7.
  misc_feature (164)..(204): Pfam Name: zf-AN1 Pfam Description: AN1-like Zinc finger
  misc_feature (77)..(101): Pfam Name: zf-A20 Pfam Description: A20-like zinc finger
  misc_feature: Functional Homolog Of Ceres SEEDLINE ID no. ME04477 at SEQ ID NO. 742
MEEQQAAAAGGGGGGGGASMCANGCGFFGSEATKKLCSKCYRDQLKAAPSSPPAAPDLVANEEEEASTAAAAADEQLALCSSGCGFFGSKETNNMCSKCYRDHLKATSPLFSSSSSPATASTTDITVPIAPATTAPTPSLKGKEEEATAAASSSAAAAAKPNRCVECRKKVGLLGFECRCGGTFCSTHRHADKHACTFDFKKSDREKIAKENPLIVAPKITKF

SEQ ID NO: 991 - protein, 171 aa, Oryza sativa subsp. japonica
  misc_feature: Public GI ID no.115468934
  misc_feature: Bit score of 385.4 for HMM based on sequences of FIGURE 7.
  misc_feature (112)..(152): Pfam Name: zf-AN1 Pfam Description: AN1-like Zinc finger
  misc_feature (14)..(38): Pfam Name: zf-A20 Pfam Description: A20-like zinc finger
  misc_feature: Functional Homolog Of Ceres SEEDLINE ID no. ME04477 at SEQ ID NO. 742
MEHKETGCQQPEGPILCINNCGFFGSAATMNMCSKCHKEMIMKQEQAKLAASSIDSIVNGGDSGKEPIIAGHAEVAVAQVEVKTLVAQPAEIAGPSEGVTVNPKGREGPNRCSTCRKRVGLTGFNCRCGNLYCAMHRYSDKHDCQFDYRTAARDAIAKANPVVKAEKLDKI

SEQ ID NO: 992 - protein, 161 aa, Oryza sativa subsp. japonica
  misc_feature: Public GI ID no.115470773
  misc_feature: Bit score of 309.6 for HMM based on sequences of FIGURE 7.
  misc_feature (102)..(142): Pfam Name: zf-AN1 Pfam Description: AN1-like Zinc finger
  misc_feature (20)..(44): Pfam Name: zf-A20 Pfam Description: A20-like zinc finger
  misc_feature: Functional Homolog Of Ceres SEEDLINE ID no. ME04477 at SEQ ID NO. 742
MAQESWKNESEETVHTPEAPILCVNNCGFFGSSMTNNMCSKCYRDFVKVTTMAAPVVEKKAFTPASSSKTPLEPAKPDEVPAAAVEDKQAAQEPPKPPSNRCLSCRKKVGLTGFQCRCGGTFCSTHRYTEAHDCTFDYKKAGRDQIAKQNPVVIAEKINKI

SEQ ID NO: 993 - protein, 173 aa, Oryza sativa subsp. japonica
  misc_feature: Public GI ID no.115444813
  misc_feature: Bit score of 352.9 for HMM based on sequences of FIGURE 7.
  misc_feature (114)..(154): Pfam Name: zf-AN1 Pfam Description: AN1-like Zinc finger
  misc_feature (14)..(38): Pfam Name: zf-A20 Pfam Description: A20-like zinc finger
  misc_feature: Functional Homolog Of Ceres SEEDLINE ID no. ME04477 at SEQ ID NO. 742
MEHKEAGCQQPEGPILCINNCGFFGSAATMNMCSKCHKEMIMKEEQAKLAASSIDSIVNGCDGGKEHIVAASGSTAVAVAQVEAKTLVVQPTDVAGTSEEVAVVPKVKEGPNRCATCRKRVGLTGFNCRCGNMYCALHRYSDKHECQFDYRTAARDAIAKANPVVKAEKLDKI

SEQ ID NO: 994 - DNA, 954 bp, Solanum lycopersicum
  misc_feature: Ceres Annot ID no. 8458774
  misc_feature: Encodes the peptide sequence at SEQ ID NO. 995
atgagtgcatcaccaattgtgaataatgaagaaatagagagaattatagagcaactgcccaaaattgattatttttggaataattatcaactttatcagtgggaagggttttggtctactcttatcattttaaaggcagccatggtcttcaaagcaaccttcaaatcaaaaccaaatgatgttctcttggcatcttccatgaaaacaggttcaacatggctcaaggccatatgtgtatccatcatgcaagctggtaataaagaggaagacgaagaagatcttttagttaaggataatcctcatttttatgttccaacaatagaggccatggattattattcaaaaactctaactcatgatctatacacaatgccctctccaagattatttcacacacatttaccttatagggttttgccagattcaattaaaaattcggataattgcaagattatatacataacaagaaatcctaaagatactttgatttctatgtggcatttcttcaacaatcgtaagcgtttagaagatctcactcctttagaagaagttgtggagaacttttgcaaaggggttcatctatatggacccttttttgaacatgttcttgaatattgggaagaaagcaaaaaaaagcctcaaaagatattattcttgaagtatgaagacttgaagatagaccctaagaaagaggtggcaaagatagccttgtttcttggaaagccttttggtaatgaagaggatttggagatagttttgaacaagtgtagcttggagaggcttaagaatttggaggttaataagagtggatcaatctactcttctgtccacaatagtgcattttttagaaaaggaattgttggggattggaagaattacatgaagcttgaaatggaagagcaacttgacaagattaccaaattgaagcttcaagggagtgaccttgaactttga

SEQ ID NO: 995 - protein, 317 aa, Solanum lycopersicum
  misc_feature: Ceres Annot ID no. 8458774
  misc_feature (1)..(317): Bit score of 240.1 for hmm based on sequences of FIGURE 4.
  misc_feature (58)..(314): Pfam Name: Sulfotransfer_1 Pfam Description: Sulfotransferase domain
  misc_feature: Functional Homolog Of SEQ ID NO. 590
MSASPIVNNEEIERIIEQLPKIDYFWNNYQLYQWEGFWSTLIILKAAMVFKATFKSKPNDVLLASSMKTGSTWLKAICVSIMQAGNKEEDEEDLLVKDNPHFYVPTIEAMDYYSKTLTHDLYTMPSPRLFHTHLPYRVLPDSIKNSDNCKIIYITRNPKDTLISMWHFFNNRKRLEDLTPLEEVVENFCKGVHLYGPFFEHVLEYWEESKKKPQKILFLKYEDLKIDPKKEVAKIALFLGKPFGNEEDLEIVLNKCSLERLKNLEVNKSGSIYSSVHNSAFFRKGIVGDWKNYMKLEMEEQLDKITKLKLQGSDLEL

SEQ ID NO: 996 - DNA, 1011 bp, Sorghum bicolor
  misc_feature: Ceres Annot ID no. 8681290
  misc_feature: Encodes the peptide sequence at SEQ ID NO. 997
atggtcgccggcgagaatggatgcgcaaacgccttctccaagtatgaggaattggcgtcgtccctccctgcatcccagaagggtatcgggagctccccgtaccggaagcacgaaggcttctggtacccggagcaccagctggcgccgacgctggcgatgcgggacacgttcgtcgcccgcccgaccgacatcatcctcgccaccattcccaagtccggcacgacgtggcttaaggccctcgtctactgtgtcgtccaccgcggccaccacgcgccggccgacgagcgccacccactcctcgtctccagcccgcacgacgtggtcccgttcctgcactccatctacgagaaccaccgctccgcgtcgcccgtcccggtcctcgaagagatgccgtcgccgcgtgtcctggccgtgcacgcgccgttcacggccctgccgccatcggtgcgggagtccgcgtgccgcgtcgtctatctgtgccgagaccccaaggacacttttgtctcgctccgtcactacgtcgacaagatcaagcccgagggatccgccatgacgccgttcgccgaggcgttcgacctgttctgcgacggcgtgtcaccgtttgggccggtctgggacaacatggccgagtactggaagaagagcatggcgcggccggaggaggtggtgttcctccggtacgaggacctgaaggaggacactgtggggaacgtgaggcgcctagcggcgttcctcggctgcccattcaccgacgaggaggcagagagaggcgtccctgaggcgattgtgacgctgtgcagtatggacaagatgaggagcgtcaaggccaaccgggatgggatgcactggaacggccgttcacgattcaagaactcggccttctttcgaaagggggaggtcggtgactggaaggcgcacatgacgctggatatggcgaggagactggatgacatcgtggaggaaaaactgcgaggaataggatctgggctctccatgatcggccagccatga

SEQ ID NO: 997 - protein, 336 aa, Sorghum bicolor
  misc_feature: Ceres Annot ID no. 8681290
  misc_feature (1)..(336): Bit score of 402.2 for hmm based on sequences of FIGURE 4.
  misc_feature (61)..(327): Pfam Name: Sulfotransfer_1 Pfam Description: Sulfotransferase domain
  misc_feature: Functional Homolog Of SEQ ID NO. 590
MVAGENGCANAFSKYEELASSLPASQKGIGSSPYRKHEGFWYPEHQLAPTLAMRDTFVARPTDIILATIPKSGTTWLKALVYCVVHRGHHAPADERHPLLVSSPHDVVPFLHSIYENHRSASPVPVLEEMPSPRVLAVHAPFTALPPSVRESACRVVYLCRDPKDTFVSLRHYVDKIKPEGSAMTPFAEAFDLFCDGVSPFGPVWDNMAEYWKKSMARPEEVVFLRYEDLKEDTVGNVRRLAAFLGCPFTDEEAERGVPEAIVTLCSMDKMRSVKANRDGMHWNGRSRFKNSAFFRKGEVGDWKAHMTLDMARRLDDIVEEKLRGIGSGLSMIGQP

SEQ ID NO: 998 - protein, 218 aa, Chlamydomonas reinhardtii
  misc_feature: Public GI ID no. 159468075
  misc_feature (1)..(218): Bit score of 139.6 for hmm based on sequences of FIGURE 13.
  misc_feature (123)..(211): Pfam Name: Synaptobrevin Pfam Description: Synaptobrevin
  misc_feature: Functional Homolog Of SEQ ID NO. 160
MPLIYSSVSQGTVTLAEYAAFSGNFGAVAKDYLEKAGKNEGKFTFNVDGHTFNFLNRGGFTYLVVADEAYGRAIPSAFLDKMASEFAMKFADKAAGAKEGGLNGSFGKQLKSMMEHATQYPEEYSKVASVQKKVDEVKGIMTENIEKVLARGEKLELLTDKTENLMNEADRFQRTGRTLRRKMWWQNCKMKIVVALAVILLAVVIFLLVCFSGGNCLK

SEQ ID NO: 999 - protein, 170 aa, Chrysanthemum x morifolium
  misc_feature: Public GI ID no.112819496
  misc_feature: Bit score of 156.0 for HMM based on sequences of FIGURE 7.
  misc_feature (111)..(151): Pfam Name: zf-AN1 Pfam Description: AN1-like Zinc finger
  misc_feature (19)..(43): Pfam Name: zf-A20 Pfam Description: A20-like zinc finger
  misc_feature: Functional Homolog Of Ceres SEEDLINE ID no. ME04477 at SEQ ID NO. 742
MAQREQERTQEARRKLRAPENHAVRQQLADFPGNPATQKPLPELLLGGHGRTTSSAGLSLPSPVLDKRSRQAVRRRWLSLRLLSHRLWRRWPPRSRRRRRRSAKTSAVNRCSRCRKRVGLTGFRCRCGHLFCGEHRYSDRHGCSYDYKSAARDAIARDNPVVRAAKIVRF

SEQ ID NO: 1000 - protein, 159 aa, Aeluropus littoralis
  misc_feature: Public GI ID no.118424243
  misc_feature: Bit score of 344.8 for HMM based on sequences of FIGURE 7.
  misc_feature (100)..(140): Pfam Name: zf-AN1 Pfam Description: AN1-like Zinc finger
  misc_feature (16)..(40): Pfam Name: zf-A20 Pfam Description: A20-like zinc finger
  misc_feature: Functional Homolog Of Ceres SEEDLINE ID no. ME04477 at SEQ ID NO. 742
MAQESWKQESHAPEAPILCINNCGFFGSSMTNNMCSKCYRDFVKLMEMDAPVVDKKLITTASSSTVPFETAKQDDTVPDAAAMDDKQPAQEPPKPPSNRCSTCRKKVGLTGFQCRCGGTFCSLHRYTDSHECTFDYKKVAREQIAKQNPVVIAEKINKI

SEQ ID NO: 1001 - protein, 222 aa, Picea sitchensis
  misc_feature: Public GI ID no. 116781485
  misc_feature (1)..(222): Bit score of 171.5 for hmm based on sequences of FIGURE 13.
  misc_feature (127)..(215): Pfam Name: Synaptobrevin Pfam Description: Synaptobrevin
  misc_feature: Functional Homolog Of SEQ ID NO. 160
MGQQSLIYSFVARGTVVLAEYTEFKGNFTTIAAQCLQKLPASNNKFTYNCDNHTFNYLVEDGFAYCVVADESVGRQVPMAFLERVKEDFKRRYGGGRADTAVGNSLNRDFGSKLKEHMQYCVDHPEEISKLAKVKAQVSEVKGVMMENIEKVLDRGEKIELLVDKTENLRFQAQDFQKQGTQLRRKMWFQNMKVKLIVLGIVVALILIIVLSVCHGFNCSKK

SEQ ID NO: 1002 - DNA, 823 bp, Gossypium hirsutum
  misc_feature: Ceres Clone ID no. 100034521
  misc_feature: Encodes the peptide sequence at SEQ ID NO. 1003
gaataagcaaggaaggaaggaagttcattcttaggtaggaggagaagagcagctagcttgaaaagagccgctgtctttttgatatatcagccaaggttttgaatttttagatggcgatactatacgcgctggttgcgcgtggatcggtggtgctggcggagtttacggcggcgtctacgaacgctagcgcgattgccaggcagattctagagaaaatacctggagaaaacgactctcacgtttcgtattcacaagatcggtacatcttccacgtcaaacgcaccgatggactcaccgttctttgtatggctgacgaaagtgccggaaggcgcattccttttgcatttcttgaagacattcatcagagatttgtgaggacttatggccgagctgtcttttcagcccttccttatggcatgaatgatgaattttcaagggttttgagtcaacaaatggaatactactcgagtgaccctaatgctgataggataaatcgactaaaaggtgaaatgagtcaggtgagaaacgtaatgatagagaatattgataaagttttggagagaggtgatcggttagaattgctggttgacaaaactgccaacatgcaaggaaatacctttcgcttccgaaagcaaactcgccgttttagaaacacagtatggtggagaaacgtcaaacttacggttgctctaataatcctcctcctaataattatttatgttgtgctggcttttgtttgccgtgggatcacactaccttcatgcctaaaatgaggtcaagagcttgagattcaaactccttcggtacttgccccctttcctct

SEQ ID NO: 1003 - protein, 220 aa, Gossypium hirsutum
  misc_feature: Ceres Clone ID no. 100034521
  misc_feature (1)..(220): Bit score of 658.3 for hmm based on sequences of FIGURE 13.
  misc_feature (123)..(211): Pfam Name: Synaptobrevin Pfam Description: Synaptobrevin
  misc_feature: Functional Homolog Of SEQ ID NO. 160
MAILYALVARGSVVLAEFTAASTNASAIARQILEKIPGENDSHVSYSQDRYIFHVKRTDGLTVLCMADESAGRRIPFAFLEDIHQRFVRTYGRAVFSALPYGMNDEFSRVLSQQMEYYSSDPNADRINRLKGEMSQVRNVMIENIDKVLERGDRLELLVDKTANMQGNTFRFRKQTRRFRNTVWWRNVKLTVALIILLLIIIYVVLAFVCRGITLPSCLK

SEQ ID NO: 1004 - DNA, 1177 bp, Gossypium hirsutum
  misc_feature: Ceres Clone ID no. 1836098
  misc_feature: Encodes the peptide sequence at SEQ ID NO. 1005
accggatcggatctacactgaattaaagaccgaccggttaccttagcttctcatctaagcgaaaaagacgaaggaaagtctccttcctttccatttctttttccttttccaaaaacctccgatacttcctctctccctttcctccgattccatatctctctctctttctgctagggtttgggagttagtgaagaaggggttgttatttcatggggcaacaatcgttgatctacgccttcgtggcacgaggcaccgtggtcttagccgactatacggagttcaccggaaacttcaccggcatagcttctcagtgtctccagaaacttccttcttcaaacaacaagttcacttacaactgcgatggccatacctttaactatctcgtcgataacggcttcacttattgtgtggttgctattgaatccgttggcagacaggttcctatggcatttcttgagagaattaaagaggatttcaccaagagatatggtggaggaaaagctgcagctgcccctgcaaacagcctgagcaaggagtttgggccaaaattaaaggagcatatgcagtattgcattgatcatcctgaggagatcagtaagattgccaaagtgaaagctcaagtttcagaagttaaaggagttatgatggaaaacattgagaaggttctggaccgtggtgagagaattgagcttctggtggatagaacagaaaatcttcgctctcaggcacaagatttccggcagcagggaacccagatgaggagaaagatgtggttacagaacatgaaggtaaagcttatagttctcggaatcttggtcgctttgatcctcatcattgtactgtctgtttgtcacggcttcaaatgttcatgaattgtatgtgcgctctacattccatcggcaactccaagatcagaattattgcaatcacaagtaatgtctaatgctctttctagttagatttccttggttcttttttttttttttggaaatcacatgtgggttatgtataaccatatcagaagactgcatttagaatataagtttgtgtttctggatccttttgatagtagtaagtttgttgaagtgtggaaatatgattaagcatctttggaaaattaatcttgatgaaagtattttcaagttatcctataatcaagccttcggattttttttag

SEQ ID NO: 1005 - protein, 220 aa, Gossypium hirsutum
  misc_feature: Ceres Clone ID no. 1836098
  misc_feature (1)..(220): Bit score of 171.6 for hmm based on sequences of FIGURE 13.
  misc_feature (127)..(215): Pfam Name: Synaptobrevin Pfam Description: Synaptobrevin
  misc_feature: Functional Homolog Of SEQ ID NO. 160
MGQQSLIYAFVARGTVVLADYTEFTGNFTGIASQCLQKLPSSNNKFTYNCDGHTFNYLVDNGFTYCVVAIESVGRQVPMAFLERIKEDFTKRYGGGKAAAAPANSLSKEFGPKLKEHMQYCIDHPEEISKIAKVKAQVSEVKGVMMENIEKVLDRGERIELLVDRTENLRSQAQDFRQQGTQMRRKMWLQNMKVKLIVLGILVALILIIVLSVCHGFKCS

SEQ ID NO: 1006 - DNA, 1018 bp, Gossypium hirsutum
  misc_feature: Ceres Clone ID no. 1895711
  misc_feature: Encodes the peptide sequence at SEQ ID NO. 1007
gacaatgtcacgctaattacttataggctaagaaccaaatccatcccaacttgtttcagatctaggtacttcagaataccctgctgaaatgaatcaaaagggcttgatttatagttttgttgcaaaaggaactgttgttttagctgagcacacatcatattctgggaactttagtaccattgctgttcaatgtttacagaagctgccttcaaatagcagcaagttcacgtattcttgtgacggtcacacatttaacttcctcattgacaatggatttgtgtttctagttgtcgcagatgaatcagttggcaggagtgtgcctttcgtttttcttgaacgggtgctagatgattttaaacaacgatatggtgcaagtataagaaatgagggtccccatcctttagctgatgatgacgatgatgacgacttatttgaggaccaatttagcattgcatataatcttgacagagaatttggaccaaggcttaaggagcacatgcaatattgtatgaaccatccagaagaaatgagtaagctctcgaagttaaaagctcaaatcactgaggtgaaggggattatgatggataacattgagaaggttttggatcgcggggagaagattgaacttctagtggacaaaactgagaacttacaattccaggctgatagcttccagaggcaagggcggcaactgcggcggaggatgtggctgcagaatctgcaaatgaaactgatggtggggggagctattcttgtgttgatcatccttttgtgggtttttgcgtgtggaggtttcaaaggttaacgttgataaccattgcattgcctatgttttcttttatatatacaaaaaataataattctacatttgtttagatgtacaaaatatagttatgctcttgactttgtacatggattgctgttgttatgtagcactaccttgccgtttaagatatgtaatcaaagctttgaattttatacttttttgaagttttctatatgaatgttttttacttgt

SEQ ID NO: 1007 - protein, 238 aa, Gossypium hirsutum
  misc_feature: Ceres Clone ID no. 1895711
  misc_feature (1)..(238): Bit score of 161.2 for hmm based on sequences of FIGURE 13.
  misc_feature (146)..(234): Pfam Name: Synaptobrevin Pfam Description: Synaptobrevin
  misc_feature: Functional Homolog Of SEQ ID NO. 160
MNQKGLIYSFVAKGTVVLAEHTSYSGNFSTIAVQCLQKLPSNSSKFTYSCDGHTFNFLIDNGFVFLVVADESVGRSVPFVFLERVLDDFKQRYGASIRNEGPHPLADDDDDDDLFEDQFSIAYNLDREFGPRLKEHMQYCMNHPEEMSKLSKLKAQITEVKGIMMDNIEKVLDRGEKIELLVDKTENLQFQADSFQRQGRQLRRRMWLQNLQMKLMVGGAILVLIILLWVFACGGFKG

SEQ ID NO: 1008 - DNA, 690 bp, Gossypium hirsutum
  misc_feature: Ceres Clone ID no. 100021678
  misc_feature: Encodes the peptide sequence at SEQ ID NO. 1188
ttgtctctcccaccaactcgcgagataacccagttgatctcagaaaggagaaaggggaaggaaaatgagtctggaaccgtttatttacagcttcgtggctcgaggaacaatgatcttggccgagtacactgagttcactgggaatttcccggccatcgcaactcagtgtttgcaaaaactcccttcttctaataacaagtttacttacaactgtgatcaccatacctttaattttcttgttgaagatggttacgcttattgtgttgttgctaaagattccgttggaaagcaaatctctattgcatttttggaacgtataaaagcggactttaagaaaagatatgggggtggaaaagctgatacagctattgccaaaagtcttaacaaggagttcggaccggttatgaaggagcacatgaaatatattattgaacatgctgaagaaatcgaaaagctattaaaggtgaaggcccaagtttcagaagttaaaagtataatgttggagaatatcgacaaggcgattgatcgaggagaaaacctaaccacacttgctgacaggaccgagaatctacgtgatcaggcccaggcatacaggaaccaagggacgaaaatccgccgtaagatgtggtatcaaaacatgaagataaagttggtggttcttggaatcttggttcttctaatccttgtaat

SEQ ID NO: 1009 - DNA, 582 bp, Sorghum bicolor
  misc_feature: Ceres ANNOT ID no.6063957
  misc_feature: Encodes the peptide sequence at SEQ ID NO 1010
atggcggagaggcaggaggtctctggcggcatggcggcgccgatgtgcgccaacgcctgcgggttcttcgggagtgcggcgaccaagaacctctgctccaagtgctacaaggagcacctgatcaagaccgccaagcaggaagcatccgccgccgtcgtcgtcggcggcgccatcgtcaagtgcgcggccgacgggtgcggtttcttcggatcctcggcgaccaacaacatgtgctccggctgctacatggacttcctcaaagacgctcacgcctcccctgctgtggcggacaaggtcgtcgtactcgctgccgagaagcagccggcggcggcccagatctctgctgcaacgtccagtactgcaccggcggcggtgaaggcggcggcggcgcccaacaggtgcgcgtcgtgccgcaagaaggtggggctgctggggttcccctgccgctgcggcggcacgttctgcgcgctgcaccggtacgcggagaagcacgcctgcgacttcgacttcaaggcggcgggccgggagaagatcgccaagaacaacccgctcgtcgtggcagccaagatcaacaagatctga

SEQ ID NO: 1010 - protein, 193 aa, Sorghum bicolor
  misc_feature: Ceres ANNOT ID no.6063957
  misc_feature: Bit score of 397.1 for HMM based on sequences of FIGURE 7.
  misc_feature (134)..(174): Pfam Name: zf-AN1 Pfam Description: AN1-like Zinc finger
  misc_feature (58)..(83): Pfam Name: zf-A20 Pfam Description: A20-like zinc finger
  misc_feature: Functional Homolog Of Ceres SEEDLINE ID no. ME04477 at SEQ ID NO. 742
MAERQEVSGGMAAPMCANACGFFGSAATKNLCSKCYKEHLIKTAKQEASAAVVVGGAIVKCAADGCGFFGSSATNNMCSGCYMDFLKDAHASPAVADKVVVLAAEKQPAAAQISAATSSTAPAAVKAAAAPNRCASCRKKVGLLGFPCRCGGTFCALHRYAEKHACDFDFKAAGREKIAKNNPLVVAAKINKI

SEQ ID NO: 1011 - DNA, 1113 bp, Sorghum bicolor
  misc_feature: Ceres ANNOT ID no.6017545
  misc_feature: Encodes the peptide sequence at SEQ ID NO 741
atggatatgagcagcagctcacctgttatcaccgatccaatatcaataagcccaccactgttgggaggcttgacatcaaatctgatgccgttttcagtcatgtctggaggttgctccagtcctagtatgaccgccagtaggcgtaaaattgaggaggtccttgttaatggcctgctagatgcaatgaaatcctcgtcaccgcgcaagaagcacaatctcgcctttggacaggataattcactcgacgaagatcctgcttacagtgcatggctgtcaaaatgcccttctgcgttgacctccttcaagcagatagtagccaatgcacaaggcaggcggattgctgtgttcttggattacgacggtaccctgtcaccaatcgttgatgatcccgacaaagcattcatgtcccctgtgatgagagctgctgtcagaaatgttgcaaagtacttccctactgcaattgtcagtggaaggtcccgtaagaaggtgtctgaatttgtgcaactgaaggaactatactacgctgggagtcatgggatggacatagtgacatctgtagcagcacatgctactgaaaagtgcaaacaagccaatctcttccaacctgcttgtgaatttcttcctatgattgacgaggtttccaagtccctcttggaggtcacgagtggaattgaaggtgcaagggttgagaacaacaagttctgtgtatctgtacattaccgcaacgtagcagagaaggactggaaagtggttgcaggcctcgtaaaacaagtattggaggcctttcctcgtctcaaagtaaccaatgggcgaatggttttagaggttcgcccagtgatcgactgggacaagggaaaggccgtcgagtttctgcttcaatcactcggcttaaacgactctgaagatgtgattcctatctacatcggagatgatcgcacggacgaagacgccttcaaggtacttcgagagcgaaaatgtggatatggaatcctagtttcgcaggtgcccaaggacactactgaagccttctactcgctgagagacccatctgaagtgatggggttcctcaattccttggtgagatggaagaagcactcactgcgacgaaactga

SEQ ID NO: 1012 - protein, 269 aa, Oryza sativa subsp. japonica
  misc_feature: Ceres SEEDLINE ID no.ME18396
  misc_feature: Bit score of 703.4 for HMM based on sequences of FIGURE 8.
  misc_feature (17)..(182): Pfam Name: adh_short Pfam Description: short chain dehydrogenase
MATVSAVSAPIRRLEGKVAIITGGASGIGEATARLFSKHGAHLVIADIQDDLGLSLCKHLESASYVHCDVTKEEDVENCVNTAVSKYGKLDIMLNNAGICDEIKTSILDNNKSDFESVISVNLVGPFLGTKHAARVMIAAKRGSIINTASVAGILGGVATHAYTSSKHALIGLMKSTAVELGQFGIRVNCVSPYVVPTPLTKKHANIDEEGVREIYSNLKGVHLVPNDVAEAALYLAGDESKYVSGHNLVLDGGFTNVNIGFSVFGQSE

SEQ ID NO: 1013 - protein, 388 aa, Vitis vinifera
  misc_feature: Public GI ID no.147865685
  misc_feature: Bit score of 666.6 for HMM based on sequences of FIGURE 8.
  misc_feature (130)..(297): Pfam Name: adh_short Pfam Description: short chain dehydrogenase
  misc_feature: Functional Homolog Of Ceres SEEDLINE ID no. ME18396 at SEQ ID NO. 1012
  misc_feature (68)..(68): Xaa is any aa, unknown, or other
  misc_feature (84)..(84): Xaa is any aa, unknown, or other
  misc_feature (144)..(144): Xaa is any aa, unknown, or other
MALWNNVEIEIDLEVACEVVVEMANVEVVVAEEMMKTVDYVHVVEIGNTYQNSGNTLLGIQIHGFTCXSRFGQGEPLLPKVLGXFREGVLSKILILAVRSLGVRDNVEDGSKAMAASSFLSVFTRRLEGKVALITGGASGIGKXTAETFTQHGAKVVIADIQDELGHSVIEALGQTNASYVHCDVTDESQIKAAVDKTAATHGKLDIMFNNAGIVNNYKPRIMDNEKADFERVLSINVTGVFLGMKHAARVMVPAKSGSIISTASVSSNVGAAATHAYCCSKHAVLGLTRNAAIELGQFGIRVNCLSPYALATPLATNFLNLTAEELETAMNATANLKGVTLKAQDVANAALYLASDESRYVSGHNLFIDGGFTVANPSFHLFQYPDS

SEQ ID NO: 1014 - protein, 278 aa, marine gamma proteobacterium HTCC2080
  misc_feature: Public GI ID no.119503368
  misc_feature: Bit score of 285.3 for HMM based on sequences of FIGURE 8.
  misc_feature (8)..(173): Pfam Name: adh_short Pfam Description: short chain dehydrogenase
  misc_feature: Functional Homolog Of Ceres SEEDLINE ID no. ME18396 at SEQ ID NO. 1012
MSKRLEGKVAVITGAASGIGAATAQRFKDEGCLLVLADIQSELGLDFAKQLGDHVYFEACDVSIETDVERVVNRAILEFGKLDIMFNNAGIVGAKGPIDLTPADEWRATTDILINGVFYGVKHAAAIMKKQRSGSIINMSSVAGVMGGLAPHAYTTAKHAVVGLTTSASAELCTHNIRVNAIAPFSMATPMVADAHLKNHLATDEVEKTLAANSPLPGRAGTALDVANAALWLGSDESGYTSGLTLTTDAGVTTGSMVRRPNYEDYVPMQREAGSQGL

SEQ ID NO: 1015 - protein, 282 aa, Thermobifida fusca YX
  misc_feature: Public GI ID no.72161874
  misc_feature: Bit score of 281.5 for HMM based on sequences of FIGURE 8.
  misc_feature (8)..(173): Pfam Name: adh_short Pfam Description: short chain dehydrogenase
  misc_feature: Functional Homolog Of Ceres SEEDLINE ID no. ME18396 at SEQ ID NO. 1012
MTQRLRGRVAAITGGASGIGEATVRRFHTEGASVVIADIQAEAGRRLADELGDRAVFVRTDVSEEADVAALVDTAVDRFGQLDIMVNNAGIMGALGPIDATRMSDADLTIAVNLRGVICGMKHAARVMKPRRSGVIISTSSPAGVLGGIGPHIYSAVKVGIIGLSNSVAAELRQHGIRVNTIIPGSVVSPMTAGIVVDDAHNLAGAQEVLGRTALLGRPIQPADVAAGILYLASDDAAFVTGAVLPVDAGLTGASWPSPYTSGRYAKPVALLEAGRRIGGEE

SEQ ID NO: 1016 - protein, 277 aa, Burkholderia fungorum LB400
  misc_feature: Public GI ID no.91780661
  misc_feature: Bit score of 242.2 for HMM based on sequences of FIGURE 8.
  misc_feature (8)..(172): Pfam Name: adh_short Pfam Description: short chain dehydrogenase
  misc_feature: Functional Homolog Of Ceres SEEDLINE ID no. ME18396 at SEQ ID NO. 1012
MSERLKDRVALVTGAASGIGAATARLMAQEGAFVVLADVDEHAGQALARELRDATFAYTDVSVEAQVAAAVDEALRLHGRLDCMVNNAGFVGAYGSILETSAAAWHATLGVLLDGVFYGIKHAARAMVKQGSGCILSVASTAGVMGGLGPHAYTSAKHAVIGLTRSAASELAPRGVRVNAVAPGTTVTEMMVQGRGSRQAAIDAATRASPLGTPLMPQEIAAALVYLASDDARHVNAHTLVVDSGVTVAGASGGAVFHNRPAGFMGRMPGGANADAR

SEQ ID NO: 1017 - DNA, 1072 bp, Zea mays
  misc_feature: Ceres CLONE ID no.287430
  misc_feature: Encodes the peptide sequence at SEQ ID NO 1018
agattttgacaacgccttcccaacttgctcgctcccgcaacgacagcgcgcacttggattcggcgaccaccggagcgcggaggaggcacaggcgccgatctagagacgatggccgccgcgggctcctcgccgtccttctcctcctcgagtaagcggctggaagggaaggtggccctcgtcaccggtggcgccaccggcatcggcgaggccatcgttcgcctcttcatggagcacggcgccaaggtctgcatcgcggacatccaggatgaggccgggcagcagctgcgcgacgccctgggaggtgacgcgcagggcgccatgttcgtccactgcgacgtgacgtcggaggaggacgtgagccgcgccgtggacgctgcggcggagcggttcggcgcgctggacgtgatggtgaataacgccggcgtgacgggcaccaaggtgacggacatccgcaccgtggacttcgcggaggcgcgcagggtgctcgacgtcaacgtgcacggcgtgttcctggtgatgaagcacgcggcgcgcgctatgatcccgcggaagcggggctccatcgtgtcgctggccagcgtggccagcgccatcggcgggacgggcccgcacgtctacacggcgtccaagcacgccgtggtcgggctcaccaagagcgtcgccgcggagctcggccgtcatggggtgcgcgtcaactgcgtgtccccctatgccgtgcccacggcgctgtcgatgccgcacctgccccagggcgcgcgcgcagatgacgcgctcaaggacttcctggcctttgtcggcggcgaggccaacctcaagggcgtcgacgccatgcccgaggacgtcgcccaggcggtgctctacctggccagcgacgaggcgaggtacgtcagcgcggtcaacctcatggtggacggaggcttcacagccgtaaacaataacctcagggcgtttgaggattagttgaggcatttatgccagctctgggattgggagggagtattaccactatttcttctgctgttgtgacaagtgagtgcaagactaataaactgcagcatgttcatgtagccag

SEQ ID NO: 1018 - protein, 283 aa, Zea mays
  misc_feature: Ceres CLONE ID no.287430
  misc_feature: Bit score of 701.2 for HMM based on sequences of FIGURE 8.
  misc_feature (20)..(189): Pfam Name: adh_short Pfam Description: short chain dehydrogenase
  misc_feature: Functional Homolog Of Ceres SEEDLINE ID no. ME18396 at SEQ ID NO. 1012
MAAAGSSPSFSSSSKRLEGKVALVTGGATGIGEAIVRLFMEHGAKVCIADIQDEAGQQLRDALGGDAQGAMFVHCDVTSEEDVSRAVDAAAERFGALDVMVNNAGVTGTKVTDIRTVDFAEARRVLDVNVHGVFLVMKHAARAMIPRKRGSIVSLASVASAIGGTGPHVYTASKHAVVGLTKSVAAELGRHGVRVNCVSPYAVPTALSMPHLPQGARADDALKDFLAFVGGEANLKGVDAMPEDVAQAVLYLASDEARYVSAVNLMVDGGFTAVNNNLRAFED

SEQ ID NO: 1019 - DNA, 837 bp, Oryza sativa subsp. indica
  misc_feature: Ceres ANNOT ID no.451889
  misc_feature: Encodes the peptide sequence at SEQ ID NO 1020
atgtccgccgccgccgcatcctcccccgctccccggttggaaagcaaggttgcgctggttaccggtggtgcttcaggtattggtgaagcaattgttcgcctctttagagagcatggtgcaaaggtatgtattgcagatatccaagatgaagcaggtcagaagctccgggactcccttggaggtgaccaagatgtcttatttgtccactgcgatgtttcggtggaagaggatgtagcccgagcggtcgatgcaacagctgaaaagtttggtactcttgacatcatggtcaacaatgctggctttacaggccagaaaatcacagatatccgaaacatcgacttttctgaagtcaggaaggtaatcgacatcaatttagttggtgtattccacgggatgaaacacgcagcccgcatcatgatccccaataagaaggggtccatcatctcattgggaagtgtttctagtgtcattggagggttgggacctcattcatacacagcaaccaagcatgctgtggtgggtctaaccaagaatgtagctggggaattggggaagcatgggatacgcgtgaactgcgtatctccctatgcagtgcccacggctctctccatgccgtatctgccccagggcgagcgcaaggatgatgccctgaaagactttttcgcctttgttggtggtgaagcaaacctgaaaggtgtggatctgctacctaaggatgttgctcaagcagtgctctacttggcaagcgatgaagcgaggtacatcagcgcgctcaacctcatggtggatggtggctttacctctgtgaatcacaatttgagagcatttgaagattaa

SEQ ID NO: 1020 - protein, 278 aa, Oryza sativa subsp. indica
  misc_feature: Ceres ANNOT ID no.451889
  misc_feature: Bit score of 705.3 for HMM based on sequences of FIGURE 8.
  misc_feature (16)..(184): Pfam Name: adh_short Pfam Description: short chain dehydrogenase
  misc_feature: Functional Homolog Of Ceres SEEDLINE ID no. ME18396 at SEQ ID NO. 1012
MSAAAASSPAPRLESKVALVTGGASGIGEAIVRLFREHGAKVCIADIQDEAGQKLRDSLGGDQDVLFVHCDVSVEEDVARAVDATAEKFGTLDIMVNNAGFTGQKITDIRNIDFSEVRKVIDINLVGVFHGMKHAARIMIPNKKGSIISLGSVSSVIGGLGPHSYTATKHAVVGLTKNVAGELGKHGIRVNCVSPYAVPTALSMPYLPQGERKDDALKDFFAFVGGEANLKGVDLLPKDVAQAVLYLASDEARYISALNLMVDGGFTSVNHNLRAFED

SEQ ID NO: 1021 - DNA, 858 bp, Arabidopsis thaliana
  misc_feature: Ceres ANNOT ID no.835908
  misc_feature: Encodes the peptide sequence at SEQ ID NO 1022
atgtcaacgaacactgaatcttcttcttattcttctcttcctagtcaaaggcttttgggtaaagtggcattgatcactggaggagccacagggataggtgagagcattgttcgtctgttccacaagcacggtgccaaagtctgcattgttgatctgcaagatgatctcggaggtgaggtgtgtaaaagtctgcttcgtggtgagtccaaggagacggcttttttcatccatggcgatgttagagtggaagatgacattagcaatgcggttgactttgcagtcaaaaattttgggacgcttgatatacttatcaacaatgcaggattatgtggagcaccgtgccctgatattcgtaattatagtttgagtgagttcgagatgacctttgatgtgaatgtgaaaggagcttttctaagcatgaaacatgcagctcgtgtaatgataccggagaagaaagggtcgatagtttccttatgtagtgtgggaggtgttgtgggaggcgttggtccacattcttatgttggttccaagcatgctgttctaggcttgactaggagtgttgcagcggagcttggacagcacgggatacgtgtgaactgtgtttcgccttacgcggttgcaactaaactcgctttggctcatttgccggaggaagaaagaacggaggatgcatttgttggtttcaggaattttgctgctgcaaacgcgaatctaaaaggggtggaactgacggttgatgatgtagcgaacgctgttctgtttttggctagcgatgactcgcggtacataagcggagataatttgatgattgatggaggattcacttgcactaaccactcctttaaagtcttcagatga

SEQ ID NO: 1022 - protein, 285 aa, Arabidopsis thaliana
  misc_feature: Ceres ANNOT ID no.835908
  misc_feature: Bit score of 588.8 for HMM based on sequences of FIGURE 8.
  misc_feature (21)..(192): Pfam Name: adh_short Pfam Description: short chain dehydrogenase
  misc_feature: Functional Homolog Of Ceres SEEDLINE ID no. ME18396 at SEQ ID NO. 1012
MSTNTESSSYSSLPSQRLLGKVALITGGATGIGESIVRLFHKHGAKVCIVDLQDDLGGEVCKSLLRGESKETAFFIHGDVRVEDDISNAVDFAVKNFGTLDILINNAGLCGAPCPDIRNYSLSEFEMTFDVNVKGAFLSMKHAARVMIPEKKGSIVSLCSVGGVVGGVGPHSYVGSKHAVLGLTRSVAAELGQHGIRVNCVSPYAVATKLALAHLPEEERTEDAFVGFRNFAAANANLKGVELTVDDVANAVLFLASDDSRYISGDNLMIDGGFTCTNHSFKVFR

SEQ ID NO: 1023 - protein, 261 aa, Bouteloua hirsuta
  misc_feature: Public GI ID no.38326750
  misc_feature: Bit score of 301.2 for HMM based on sequences of FIGURE 8.
  misc_feature (35)..(204): Pfam Name: adh_short Pfam Description: short chain dehydrogenase
  misc_feature: Functional Homolog Of Ceres SEEDLINE ID no. ME18396 at SEQ ID NO. 1012
MPALDVLPEKPHHGWESNGAAAIAPTPAPRRLDGKVAIVTGGARGIGEAIVRLFARHGARVVIADVDAAAGDALAAALGPQVSCVRCDVSVEDDVRRAVEWAVARHGRLDVLCNNAGVLGRQTRAAKSILSFDAGEFDRVLRVNALGAALGMKHAARAMAPRRAGSIVFVASVAGVLGGLGPHAYTASKHAIVGLTKNAACELGAHGIRVNCVSPFGVATPMLINAWRQGHADAVPSDEEVEKMEEVVRGLATLKGPTLRP

SEQ ID NO: 1024 - DNA, 941 bp, Gossypium hirsutum
  misc_feature: Ceres CLONE ID no.1939396
  misc_feature: Encodes the peptide sequence at SEQ ID NO 1025
aaaagatcagcgtttccacaatgtccaataacaagctagaaggcaaagtagccatcatcaccggtggagcgagcggtatcggcaaagccaccgcctgtctcttcgccaagcacggtgcccgtgtggtgatcgccgacatccaagatgaactaggccagcaggtagccgcatcaatcggttcccaaaagtgcagctacatccactgtgatgttaccgatgaagagcaagtgaaaggcatagtggaatggaccgtccaaaaccatggccaactcgacatcatgtttagcaatgctgggatagtacgttccaacaagggtaccacctccaactccaaccagaacatcctcgacctagacctcgcgcctttcgaccacctgttcgccgtcaacgcccgcggcatggcggcttgcgtcaaacactcggcgcgttccatggttgagaagcgcgtgagagggagcatcatctgcacggccagtgtatgcgccagctgcggcggggaacaccacgtggattactttatgtcgaagcatgcggtgttgggattggtgaggtcggcgagcaagcagcttggggtgcacgggatcagagtaaatagcgtgtcgccgttcgcggtggcgaccccattgatatgtaacctgacgggaatgaaagcgaggaagctgagaagttttacgaggggaggacgattttgaaaggggtagtggtgaaagagaagcacgtggctgacgcggtgttgtttctagcatcggaagattcggaggtggtgagcggacatgacatggtagtggatgctgggtttttgggcaaatagttaaatggttggtcaccggtaggtcggcctaaaatcatgaaatatggtccacgctcctttgtttgttcaataaggacttgcttttatgaaataatttcatatcttttcagaaaaaaaaaaaaaaaaaaaa

SEQ ID NO: 1025 - protein, 223 aa, Gossypium hirsutum
  misc_feature: Ceres CLONE ID no.1939396
  misc_feature: Bit score of 228.5 for HMM based on sequences of FIGURE 8.
  misc_feature (9)..(184): Pfam Name: adh_short Pfam Description: short chain dehydrogenase
  misc_feature: Functional Homolog Of Ceres SEEDLINE ID no. ME18396 at SEQ ID NO. 1012
MSNNKLEGKVAIITGGASGIGKATACLFAKHGARVVIADIQDELGQQVAASIGSQKCSYIHCDVTDEEQVKGIVEWTVQNHGQLDIMFSNAGIVRSNKGTTSNSNQNILDLDLAPFDHLFAVNARGMAACVKHSARSMVEKRVRGSIICTASVCASCGGEHHVDYFMSKHAVLGLVRSASKQLGVHGIRVNSVSPFAVATPLICNLTGMKARKLRSFTRGGRF

SEQ ID NO: 1026 - DNA, 1123 bp, Zea mays
  misc_feature: Ceres CLONE ID no.403637
  misc_feature: Encodes the peptide sequence at SEQ ID NO 1027
atttggcaactcaatgcccagctctcatcaggagctcaacaaagtctgttaggatgctgagagcaacgcacctcgctttcaggagggacaagggtacggctgcgggagccgccttgcgtggcgtcgtcggtggtttctcgacggcgtcagactcccagtcccaaaggctagccggcaaggtcgccgtcatcaccggcgcggccagcggcatcggcagggcgacggccgccgagttcgtccggaacggcgccaaggtcatcctcgcggacgtgcaggacggcgccggccgcgccgtggccgccgagctcggcccggccgcggcctacgcccgctgcgacgtcacggacgaggcccagatcgccgcggcggtggacctcgccgtggcgcgccacggccgcctggacgtgctgtacagcaacgcgggcgcgccgggcgcctcggcgcccgcgccgctgccgtcgctcgacctcgccgacttcgaccgcgtcatggcggtcaacgcgcggtccgcggtggcgtgcctcaagcacgccgcgcgcgtcatggtgccccagggcgccggctgcgtcctgtacacggggagcactacgggtatgctcggcggcctcgccgcgctgccctacagcctgtccaaggccacggtcatctccgtggtgcgggccgccgcggacgagctggcgcggtcgggggtgcgcgtcaacgccatctcgccgcacgccatcgccacgccgctgctgctccgctccctcgccaggctgcacccaggcgtccccgacgagcagctgaagcgcctggtggagactggcatgagcgacctccgtggtgcggtgctgcaggtccaggacgtcgcaagggcggccgtctacctggcctccgacgaggccaagttaccgggcataatctcgtggttgacggtgggttcacggccagcaagcggatcggcacgccggcggcaagctcaaccgctagctgaccattctcctggacaggtcctgcgaataattataaatcaatgtacttggttgatcgtgagttgtgagttgtgaccggattgatatgaaacctagcattctaaagtatcaaccagcgttacattatcagtactaaaaaaaaaaaaaaaaaa

SEQ ID NO: 1027 - protein, 330 aa, Zea mays
  misc_feature: Ceres CLONE ID no.403637
  misc_feature: Bit score of 221.8 for HMM based on sequences of FIGURE 8.
  misc_feature (42)..(209): Pfam Name: adh_short Pfam Description: short chain dehydrogenase
  misc_feature: Functional Homolog Of Ceres SEEDLINE ID no. ME18396 at SEQ ID NO. 1012
MLRATHLAFRRDKGTAAGAALRGVVGGFSTASDSQSQRLAGKVAVITGAASGIGRATAAEFVRNGAKVILADVQDGAGRAVAAELGPAAAYARCDVTDEAQIAAAVDLAVARHGRLDVLYSNAGAPGASAPAPLPSLDLADFDRVMAVNARSAVACLKHAARVMVPQGAGCVLYTGSTTGMLGGLAALPYSLSKATVISVVRAAADELARSGVRVNAISPHAIATPLLLRSLARLHPGVPDEQLKRLVETGMSDLRGAVLQVQDVARAAVYLASDEAKLPGIISWLTVGSRPASGSARRRQAQPLADHSPGQVLRIIINQCTWLIVSCEL

SEQ ID NO: 1028 - protein, 285 aa, Zea luxurians
  misc_feature: Public GI ID no.42539907
  misc_feature: Bit score of 372.1 for HMM based on sequences of FIGURE 8.
  misc_feature (27)..(197): Pfam Name: adh_short Pfam Description: short chain dehydrogenase
  misc_feature: Functional Homolog Of Ceres SEEDLINE ID no. ME18396 at SEQ ID NO. 1012
MSPSHHGWDGNGAAAVPTPMPKRLDGKVAIVTGGARGIGEAIVRLFAKHGARVVIADIDDAAGEALASALGPQVSFVRCDVSVEDDVRRAVDWALSRHGGRLDVYCNNAGVLGRQTRAARSILSFDAAEFDRVLRVNALGAALGMKHAARAMAPRRAGSIVSVASVAAVLGGLGPHAYTASKHAIVGLTKNAACELGAHGVRVNCVSPFGVATPMLINAWRQGHDDATADADRDLDLDVTVPSDQEVEKMEEVVRGLATLKGPTLRPRDIAEAVLFLASDEARYI

SEQ ID NO: 1029 - DNA, 1041 bp, Gossypium hirsutum
  misc_feature: Ceres CLONE ID no.1836494
  misc_feature: Encodes the peptide sequence at SEQ ID NO 1030
atcattgtccatttactctgagtggcaaaatcggctaactctacaatgtccaacaagctagaaggtaaaatagccataatcaccggtggagctagcggcattggagaagccgccgctcatcatttcgctgcccatggtgctcaaatgatcgtgattgctgacatccaagatgaattaggccaaaaggtagtcgaatcgatcggttcccataagtgctcattcatgcactgcgatgttaccgatgaagagcaagtaaagaacttagttcaatcgacggtccaaaactatgggcggcttgatatcatgttcggtaacgctgggatatttagcagctccactcaaaccgtccttgaactggacttagcacagtttgaccgcctcttcaacataaatgtccgtggcatggctgcttgcgtgaaacacgctgcacgagccatggtggaactgaatgtgagaggaagtatcgtttgtacggcgagcgtcgcatctagcaccgctggtgaaatgaacaccgactatttcattacaaagcatgcagtgcttgggttgatgagatcggcaagcaaacagcttggggtgcatgggattagggtaagcagtgtgtctccgtctgctgtgggaaccccgttactctgtcggtacctcgggaaggaggtggaggaagtggagcagacctatgaaccctacactcggttgaaaggggtggtgctgaaaacgaagcatgttgctgatgccgtgctgtttcttgcgtcccaggattctgagcttattaccgggcatgacttggtggtggatgctggttatcatctagtctactagacaccaggtgttcgattatttggcgcagtgagctagggccagccacttgatgtttgattggtgatagctcaaacatggccagcagcctctcaatattatgcaccttcgaatttgattatgttttaatgttttcatataaataaaaggtttttgtattttatacattttaatgcatcatatatagtgatacttctttaattgtaaaaaaaaaaaaaaaaaaaa

SEQ ID NO: 1030 - protein, 257 aa, Gossypium hirsutum
  misc_feature: Ceres CLONE ID no.1836494
  misc_feature: Bit score of 311.4 for HMM based on sequences of FIGURE 8.
  misc_feature (8)..(177): Pfam Name: adh_short Pfam Description: short chain dehydrogenase
  misc_feature: Functional Homolog Of Ceres SEEDLINE ID no. ME18396 at SEQ ID NO. 1012
MSNKLEGKIAIITGGASGIGEAAAHHFAAHGAQMIVIADIQDELGQKVVESIGSHKCSFMHCDVTDEEQVKNLVQSTVQNYGRLDIMFGNAGIFSSSTQTVLELDLAQFDRLFNINVRGMAACVKHAARAMVELNVRGSIVCTASVASSTAGEMNTDYFITKHAVLGLMRSASKQLGVHGIRVSSVSPSAVGTPLLCRYLGKEVEEVEQTYEPYTRLKGVVLKTKHVADAVLFLASQDSELITGHDLVVDAGYHLVY

SEQ ID NO: 1031 - protein, 283 aa, Zea mays subsp. mays
  misc_feature: Public GI ID no.15192945
  misc_feature: Bit score of 360.9 for HMM based on sequences of FIGURE 8.
  misc_feature (27)..(197): Pfam Name: adh_short Pfam Description: short chain dehydrogenase
  misc_feature: Functional Homolog Of Ceres SEEDLINE ID no. ME18396 at SEQ ID NO. 1012
MSPSHHGWDGNGAAAVPTPMPKRLDGKVAIVTGGARGIGEAIVRLFAKHGARVVIADIDDAAGEALASALGPQVSFVRCDVSVEDDVRRAVDWALSRHGGRLDVYCNNAGVLGRQTRAARSILSFDAAEFDRVLRVNALGAALGMKHAARAMAPRRAGSIVSVASVAAVLGGLGPHAYTASKHAIVGLTKNAACELGAHGVRVNCVSPFGVATPMLINAWRQGHDDTTADADRDLDLDVTVPSDQEVEKMEEVVRGLATLKGPTLRPRDIAEAVLFLASDEAR

SEQ ID NO: 1032 - DNA, 541 bp, Parthenium argentatum
  misc_feature: Ceres CLONE ID no.1607947
  misc_feature: Encodes the peptide sequence at SEQ ID NO 1033
  misc_feature (476)..(476): n is a, c, t, g, unknown, or other
  misc_feature (477)..(477): n is a, c, t, g, unknown, or other
  misc_feature (478)..(478): n is a, c, t, g, unknown, or other
atctatatcactctcacccttcaagatacaatgacaactcctacaagaaggctagaaggaaaggtagcgttgattaccggagcagcaagcggtattggagagtgtactgcaaaactctttgctgaacatggtgccaaaataataattgcagacattcgagacaagcttggtcaagcggtttgtgacgccataggcccatcaaactctatatacgtccactgtgacgtaaccaatgaagaacatgtcaagaacgctgtagatattgcgatcaccacttatggaaaacttgatatcatgttcaataatgcagcagtgttaggtcccaacaaaccaccaatcatcgataatgagaaaagtgattttgaacgtgtgctaagtgttattgttaccggtgtctttcttggcatgaagcatgctgctagggttatggtccccgcaaaaagaggggtaataatctcaacagctagtgttgcttnnnatgttggtggattggcgccacatgcctactgttgtgcaaagcatggtgtggtcgggttaacca

SEQ ID NO: 1033 - protein, 170 aa, Parthenium argentatum
  misc_feature: Ceres CLONE ID no.1607947
  misc_feature: Bit score of 254.5 for HMM based on sequences of FIGURE 8.
  misc_feature (11)..(170): Pfam Name: adh_short Pfam Description: short chain dehydrogenase
  misc_feature: Functional Homolog Of Ceres SEEDLINE ID no. ME18396 at SEQ ID NO. 1012
  misc_feature (149)..(149): Xaa is any aa, unknown, or other
  misc_feature (150)..(150): Xaa is any aa, unknown, or other
MTTPTRRLEGKVALITGAASGIGECTAKLFAEHGAKIIIADIRDKLGQAVCDAIGPSNSIYVHCDVTNEEHVKNAVDIAITTYGKLDIMFNNAAVLGPNKPPIIDNEKSDFERVLSVIVTGVFLGMKHAARVMVPAKRGVIISTASVAXXVGGLAPHAYCCAKHGVVGLT

SEQ ID NO: 1034 - DNA, 1136 bp, Arabidopsis thaliana
  misc_feature: Ceres CLONE ID no.115880
  misc_feature: Encodes the peptide sequence at SEQ ID NO 1035
atgctagtatgcttcaggttcaatcaccgccccattagattctctctccctctctaaagaccacacctttatgttccctctatatctatataagacgcaaacacagggaccattctcttcaaagacgagaaattataagttaggaaacgacaaagaccgatctatatatatatctcggagcaatatagctagcacaaacatgtttcagattggaaaaaacgcattattcaagaatgtgagcaagaacttccttatcaagggaatatcctcatcctcatcatctcattcaacttcaaggaagctagaaggtaaagtagcactcatcactggaggagcaagtgggattggcaaagcaacagccggaaaattcatcagtcatggagccaaagttatcattgccgatatccaaccgcagattgggcgagaaaccgagcaagaactcggtcccagttgtgcttacttcccatgcgatgtgaccaaagaatcagacattgctaacgcagttgacttcgctgtctcgctccatacaaagctcgacattatgtacaacaatgctggtattccctgcaaaacgcctcctagtatcgttgatcttgatctcaatgttttcgacaaggtaatcaacacaaatgtccgtggagtcatggcaggaatcaaacatgctgctcgtgtgatgatcccgcgtaactctggatccatcatttgtgcagggagtgtcacggggatgatgggcggtttagcccaacatacttacagcgtctcaaaatccgctgttatcggaattgtaagatcaacagcttcagaactatgcaagcacaggatccgggtcaactgcatttctccttttgcgatcacaacatcattcgtgatggatgagatgcgacagatttaccccggtgttgatgactcaaggctgatccagatagtgcagagtacaggagtgttaaatggagaggtttgtgaaccaaccgatgtagctaatgcagcggtgtatctcgcttccgatgattcaaagtatgtaaatgggcataatctggtggtagatggaggattcacaactgtaaagacgttagatttccctgcacctgaccaagtgaagtaacaaaactcataatatacaaagaaaactgttcttg

SEQ ID NO: 1035 - protein, 343 aa, Arabidopsis thaliana
  misc_feature: Ceres CLONE ID no.115880
  misc_feature: Bit score of 382.7 for HMM based on sequences of FIGURE 8.
  misc_feature (81)..(247): Pfam Name: adh_short Pfam Description: short chain dehydrogenase
  misc_feature: Functional Homolog Of Ceres SEEDLINE ID no. ME18396 at SEQ ID NO. 1012
MFPLYLYKTQTQGPFSSKTRNYKLGNDKDRSIYISRSNIASTNMFQIGKNALFKNVSKNFLIKGISSSSSSHSTSRKLEGKVALITGGASGIGKATAGKFISHGAKVIIADIQPQIGRETEQELGPSCAYFPCDVTKESDIANAVDFAVSLHTKLDIMYNNAGIPCKTPPSIVDLDLNVFDKVINTNVRGVMAGIKHAARVMIPRNSGSIICAGSVTGMMGGLAQHTYSVSKSAVIGIVRSTASELCKHRIRVNCISPFAITTSFVMDEMRQIYPGVDDSRLIQIVQSTGVLNGEVCEPTDVANAAVYLASDDSKYVNGHNLVVDGGFTTVKTLDFPAPDQVK

SEQ ID NO: 1036 - DNA, 1068 bp, Glycine max
  misc_feature: Ceres CLONE ID no.1074009
  misc_feature: Encodes the peptide sequence at SEQ ID NO 1037
ctcgccgagtcacatttgccacgtcgtggagagtataggaactcggcagaccagcaagatgttccgggctatgcaggtcgtcctcaggggggagggccgtcgtgctgcggcggctggcttgaccggccactgcggctactccacggcctcgagctcccagaggttggctggtaaggtggccgttatcaccggcgccgctagcggcatcggcaaggcgacggccgcggagttcgtcaggaacggcgccaaggtcgtgctcgccgacgtccaggacgacctgggccgcgccctggcggccgagctcggcgctgactccgcgtcctacacccgctgcgacgtcacggacgaggcgcaggttgcggcggtggtcgacctcgccgtggcccgccacggcaagctggacatcatgctcaacaacgccggcatcgtgggctccctggcgcggcccgagctgggcgctctcgacctcgccgacttcgacgccgtcatggcgatcaacacccggggcgtcatggccggcgtcaagcacgcaacccgcgtcatggcgccgcgccgcgcgggcagcatcatctgcacggccagcatcgccggcgtgctgggccagctcacgccgcacccgtacagcgtctccaagttcgcggtggtggggctcgtgcgcgccgtagccggggagctggcgcgctcgggcgtgcgcgtcaacgccatctcgcccaactacatcctgacgccgctggtgaagcgcatcctgcaggagtggtacccggaggcgagcggcgaggagcaccggcggatcgtggagagcgacatcaacgagatggaaggcgtggtgctggaggtggaggacatcgccaaggcggctctgtacctggcgtctgacgactccaagtacgtcaacggccacaacctcgtcgtcgacggcgggttcacggtggggaaggcacccaacatgccggcaccggcgcagtgaagggacacaatcggagtcagcgtattgctctaccggaacaaatctgtttatttcttcagcattgcaaaagaaaaccttcgtgatgaaaaaaaaaaaaaaaa

SEQ ID NO: 1037 - protein, 298 aa, Glycine max
  misc_feature: Ceres CLONE ID no.1074009
  misc_feature: Bit score of 355.2 for HMM based on sequences of FIGURE 8.
  misc_feature (35)..(203): Pfam Name: adh_short Pfam Description: short chain dehydrogenase
  misc_feature: Functional Homolog Of Ceres SEEDLINE ID no. ME18396 at SEQ ID NO. 1012
MQVVLRGEGRRAAAAGLTGHCGYSTASSSQRLAGKVAVITGAASGIGKATAAEFVRNGAKVVLADVQDDLGRALAAELGADSASYTRCDVTDEAQVAAVVDLAVARHGKLDIMLNNAGIVGSLARPELGALDLADFDAVMAINTRGVMAGVKHATRVMAPRRAGSIICTASIAGVLGQLTPHPYSVSKFAVVGLVRAVAGELARSGVRVNAISPNYILTPLVKRILQEWYPEASGEEHRRIVESDINEMEGVVLEVEDIAKAALYLASDDSKYVNGHNLVVDGGFTVGKAPNMPAPAQ

SEQ ID NO: 1038 - DNA, 969 bp, Glycine max
  misc_feature: Ceres CLONE ID no.476073
  misc_feature: Encodes the peptide sequence at SEQ ID NO 1039
ttggtcctctctatccatagagcctcacattactgagaagataatatagaatggctgaatcagcaaactcaatccacaacagtggccagaaaaagttagccggcaaagttgccataatcaccggcggagccagcggcatcggcgaagagacggcgcgtctgtttgctcaccatggtgcacgaatggttgtgattgcagacatccaagatgacctgggtatccaagtagcagcatccattggctctcacaggtgcagctatgtccgttgtgacgtgacagacgaagaccaagtcaaaaacctcgtggattccacggtcaacgctcacggccagctggacatcatgttcagcaacgcgggcatcctcagtccctccgaccagacaatcctcgacctcgacttctccgcgtacgaccgtctcctcgccgtgaacgcgcggggcacggcagcgtgcgtgaagcacgcagcgcggtcgatggtggagcggcgcgtgaggggcagcattgtgtgcacggcgagcgtgtcagcgtcgcacggcggcctgcggcgaaccgactacgtgatgtcgaagcacgcggtgaaggggctcatgcgcgcggccagcgcgcagcttggagcgcatggtgttagggtgaactgcgtctcgccgagtgggttgaccacgccgctgacacgtgccgcgcatgccgcgatggagacgaaggagttgcagaagcagtacgcgcagagctctaggttgaaaggtgtctttttgacgccgaagcatgtcgcggatgcggtgctgtttcttgcgtgcggtgactccgagtttgtaaccggacacgatcttgtggtggacggttgttttgacggtgtttagagtgtgtttggttttagttgaaaagcttcaaatgtacgttcaaggataaggagaactaataatttagtgccaacgatctgaaacggtaaaataaacaagtatttagttttag

SEQ ID NO: 1039 - protein, 268 aa, Glycine max
  misc_feature: Ceres CLONE ID no.476073
  misc_feature: Bit score of 327.1 for HMM based on sequences of FIGURE 8.
  misc_feature (19)..(188): Pfam Name: adh_short Pfam Description: short chain dehydrogenase
  misc_feature: Functional Homolog Of Ceres SEEDLINE ID no. ME18396 at SEQ ID NO. 1012
MAESANSIHNSGQKKLAGKVAIITGGASGIGEETARLFAHHGARMVVIADIQDDLGIQVAASIGSHRCSYVRCDVTDEDQVKNLVDSTVNAHGQLDIMFSNAGILSPSDQTILDLDFSAYDRLLAVNARGTAACVKHAARSMVERRVRGSIVCTASVSASHGGLRRTDYVMSKHAVKGLMRAASAQLGAHGVRVNCVSPSGLTTPLTRAAHAAMETKELQKQYAQSSRLKGVFLTPKHVADAVLFLACGDSEFVTGHDLVVDGCFDGV

SEQ ID NO: 1040 - DNA, 1043 bp, Glycine max
  misc_feature: Ceres CLONE ID no.554053
  misc_feature: Encodes the peptide sequence at SEQ ID NO 1041
accataaaatggagccacaacatgtgactgatcagaatatagaaactaaaaaatcatcaacaaaaaggctagctgataaggtggcagttataactggtggtgcaagaggaattggtgcagctgcagctaaactgtttgctgaaaatggagcacatgtggtcattgctgatgtgcttgatgaactaggcaccaccgtggccaagtccattggcggccactacatacactgtgatgtgtcgaaggaagatgatgttgaatcagccataaaccttgcactatcatggaagggccatctagacatcatgctcagcaatgctggaattggaggcccagagggaagaagcatcacaacccttgaaatggaccgagtgaggcacttgttctccatcaatctttatggaacaatacatggaatcaagcatgctgcaagggcaatgatcaaaggtaacaacaaaggaggatccatcatatgtacttcaagtgctgcatccatcatgggtggattggccttgcatggatataccatgacaaaagcagcaattgatgggttggtgagaagtgctgcttgtgagttgggagagcatttgattcgtgttaactgcatttccccacatggagtcccctctgagatgcttctcagtgcttgtagaagatttggacatgatgatattacccctcaaggggtgaaggaaatgattgggagcagggcaagtttgcttaaggggaaaggtgcaaccattgaagatgtggcacatgctgctttgttcttggctagtgatgagtctggcttcattacagcacacaatcttcttattgatgggggacacacatctgctgatagcagaatgagttacatgtaccaagacccaaaatgatgagaattatgtaactatcgtttgtagaggaaacacaagaacttgatgatagaatataaaagatttacaataattacatatattctatcacttgatactcttaactttatctactatagttctttaatttccattcgagaataatatatcgtttcttctttgggcctt

SEQ ID NO: 1041 - protein, 288 aa, Glycine max
  misc_feature: Ceres CLONE ID no.554053
  misc_feature: Bit score of 341.1 for HMM based on sequences of FIGURE 8.
  misc_feature (24)..(190): Pfam Name: adh_short Pfam Description: short chain dehydrogenase
  misc_feature: Functional Homolog Of Ceres SEEDLINE ID no. ME18396 at SEQ ID NO. 1012
MEPQHVTDQNIETKKSSTKRLADKVAVITGGARGIGAAAAKLFAENGAHVVIADVLDELGTTVAKSIGGHYIHCDVSKEDDVESAINLALSWKGHLDIMLSNAGIGGPEGRSITTLEMDRVRHLFSINLYGTIHGIKHAARAMIKGNNKGGSIICTSSAASIMGGLALHGYTMTKAAIDGLVRSAACELGEHLIRVNCISPHGVPSEMLLSACRRFGHDDITPQGVKEMIGSRASLLKGKGATIEDVAHAALFLASDESGFITAHNLLIDGGHTSADSRMSYMYQDPK

SEQ ID NO: 1042 - DNA, 1706 bp, Triticum aestivum
  misc_feature: Ceres CLONE ID no.677797
  misc_feature: Encodes the peptide sequence at SEQ ID NO 916
atcaaaccctctccctcctccactccccccgaaccagcgccatcacatcttctcttctcttcgtccgttgctcccgttgaagcccaggcaccttcttgctttctcccaccgcttcttcggtctctctccctgtgtcggcccgcgctctcgtcatgacgaaccacgccgcctttgctgccgaggacgcggtcaccgccgtggcggcgccggtgcagccgggtcgccatttcgcgtcgttcccgccgcggagggcccgcgactgcaggaaggccgccctgggccgcatggatctcgccacctcgggggtgctgatggccgggtctctgctggactcgatgaaggcctcctcgccccgccacgccatgccccccgccggcgccgaccacgaggagtggatcgagaagcacccgtcagcattggagtggttcgagggcgtgctcgcggcgaccgaggggaagcagatcgtcatgttcctcgactacgacggcaccctttcgccgatcgtccaggaccccgaccgcgccgtcatgaccgaggagatgagggatgcggtgaggggcgtcgcgcagcatttcccgacggccatcgtgagtgggagatgcagagacaaggtgttcaactttgtgaaactggaggagctgtactacgccgggagccacggcatggacatcaagggccccaccaaagtgtctaaccacaaggcaaaggctgacgaggttctgtgccagccggcgaccgagttcttgcctgtcattcaggaggtgtatgagaagctgacggcgaagatggagtccatcccgggggccatggtggagaacaacaagttttgcctctcggtgcacttccgctgcgtcgaggaggcggaatgggatgctctgggcagggaggtgaaggcagtgctggacgactacccgaaactctgcctcaccaaggggagaaaggtcctcgagatccggccctccatcgagtggaacaagggacacgctctcaagttcttgctcaagtctctcggctatgcggggcgcagcgacgttttcccgatatacatcggggatgaccgcacagatgaggatgcattcaaggtgctgcgcaacatgggacaaggcatcgggatccttgtgaccaagtttccgaaggacacaagcgcatcctactctctgcgtgagcctgctgaggtaaaggagttcctgcgcaagctggtgaagagcaacgcgacaaagaaggggtaattcatcgatcaacagccctctagctctaactcaacatggagatcgagcaacctatatagctagtgcatcaagtctagcttgttccttcctggacttgatggtgtctttggcgtttgattttagtagaacaatgcatgcatgcgtgttgggatccatgtataagatccagatcgagcagtgacccctgccctgctaggccttggctttgaaggtttctattactgtatccttctcgcgaggtcttgtaattagccttccgttattagctattcccttcgttccaaattactcgtcgcagaaatggatgtatctagaactaaaatacatctagatacatccatacctgcgacaagtaattcggaacggagggagtatgacagaaatgggagtgacaaagtagccctcccttttctcaccccgcactgtaaaattgttctcgcttgcttccttccttccttcctaaaaaaaaaaaaaaaa

SEQ ID NO: 1043 - protein, 362 aa, Triticum aestivum
  misc_feature: Ceres CLONE ID no.941845
  misc_feature: Bit score of 565.8 for HMM based on sequences of FIGURE 9.
  misc_feature (108)..(334): Pfam Name: Trehalose_PPase Pfam Description: Trehalose-phosphatase
  misc_feature: Functional Homolog Of Ceres SEEDLINE ID no. ME20095 at SEQ ID NO. 1129
MANQDVVLRPDMGGIASAAAMPGSSSRPIFACRGAASTSLRRRSGVDDDYGARSPCATSWVVQAMRASSPARSAAVDEYAAWTRKHPSALASFEQIAASAKGKQVVVFLDYDGTLSPIVADPDTAFITGEMREAVRGVAKHFPAAIVTGRCVEKVCSFVGLSELYYAGSHGMDIKGPGSNAEEVLLQPAREFLPVIAEVYEALVEKTKSTPGARVENKFCLSVHFRCVDEKRWSPLAEQVKEVLRDYPDLRLNEGRKVLEIRPSIMWDKGKAVEFLLQSLGFDGRSDVLPLYLGDDRTDEDAFKMLRKRGHGLGILVSKCPRETDASYSLQDPTEVMEFLHRLVQWKRRRSSSSSSAMRARV

SEQ ID NO: 1044 - DNA, 1284 bp, Zea mays
  misc_feature: Ceres CLONE ID no.391449
  misc_feature: Encodes the peptide sequence at SEQ ID NO 1045
agattttgacaacgccttcccaacttgctcgctcccgcaacgacagcgcgcacttggattcggcgaccaccggagcgcggaggaggcacaggcgccgatctaaagacgatggccgccgcgggctcctcgccgtccttctcctcctcgagtaagcgggcgatgaattgaaggatccacccaggccaagcactggtgctctgtgcttatcttttagcgagcgaagtggtcatttccccctctcttctttatgggaggaaaataggaaatggtgtgccaagtgtatcctcaaccattctactgttccaaacgtgcagtatacatcggcatacagtcgatccagttgcaacaccatagctggaagggaaggtggccctcgtcactggtggcgccaccggcatcggtgaggccatcgttcgcctcttcatggagcacggcgccaaggtctgcatcgcggacatccaggatgaggctgggcagcagctgcgcgacgccctgggaggtgacgcgcagggcgccatgttcgtccactgcgacgtgacgtcggaggaggacgtgagccgcgccgtggacgctgcggcggagcggttcggcgcgctggacgtgatggtgaacaacgccggcgtgacgggcaccaaggtgacggacatccgcaacgtggacttcgcggaggcgcgcagggtgctcgacgtcaacgtgcacggcgtgttcctggggatgaagcacgcggcgcgcgctatgatcccgcggaagcggggctccatcgtgtcgctggccagcgtggccagcgccatcggcgggacgggcccgcacgtctacacggcgtccaagcacgccgtggtcgggctcaccaagagcgtcgccgcggagctcggccgccacggggtgcgcgtcaactgcgtgtccccctatgccgtgcccacggcgctgtcgatgccgcacctgccccagggcgcgcgcgcagatgacgcgctcaaggacttcctggcctttgtcggcggcgaggccaacctcaagggcgtcgacgccatgcccgaggacgtcgcccaggcggtgctctacctggccagcgacgaggcgaggtacgtcagcgcggtcaacctcatggtggacggaggcttcacagccgtaaacaataacctcagggcgtttgaggattagttgaggcatttatgccagctctgggattgggagggagtattaccgctatttcttctgctgttgtgacaagtgtgtgcaagactaataaaccgcagcatgttcatgtagccaaaaaaaaaaaaaaaa

SEQ ID NO: 1045 - protein, 244 aa, Zea mays
  misc_feature: Ceres CLONE ID no.391449
  misc_feature: Bit score of 560.5 for HMM based on sequences of FIGURE 8.
  misc_feature (18)..(150): Pfam Name: adh_short Pfam Description: short chain dehydrogenase
  misc_feature: Functional Homolog Of Ceres SEEDLINE ID no. ME18396 at SEQ ID NO. 1012
MEHGAKVCIADIQDEAGQQLRDALGGDAQGAMFVHCDVTSEEDVSRAVDAAAERFGALDVMVNNAGVTGTKVTDIRNVDFAEARRVLDVNVHGVFLGMKHAARAMIPRKRGSIVSLASVASAIGGTGPHVYTASKHAVVGLTKSVAAELGRHGVRVNCVSPYAVPTALSMPHLPQGARADDALKDFLAFVGGEANLKGVDAMPEDVAQAVLYLASDEARYVSAVNLMVDGGFTAVNNNLRAFED

SEQ ID NO: 1046 - protein, 369 aa, Arabidopsis thaliana
  misc_feature: Public GI ID no.30683008
  misc_feature: Bit score of 725.7 for HMM based on sequences of FIGURE 9.
  misc_feature (116)..(350): Pfam Name: Trehalose_PPase Pfam Description: Trehalose-phosphatase
  misc_feature: Functional Homolog Of Ceres SEEDLINE ID no. ME20095 at SEQ ID NO. 1129
MSASQNIVVSETTMSSIIPNNNNNNNNSSSQKLPPCLISISKKKLLKNIDIINGGGQRINAWVDSMRASSPTHLKSLPSSISTQQQLNSWIMQHPSALEKFEQIMEASRGKQIVMFLDYDGTLSPIVDDPDKAFMSSKMRRTVKKLAKCFPTAIVTGRCIDKVYNFVKLAELYYAGSHGMDIKGPAKGFSRHKRVKQSLLYQPANDYLPMIDEVYRQLLEKTKSTPGAKVENHKFCASVHFRCVDEKKWSELVLQVRSVLKKFPTLQLTQGRKVFEIRPMIEWDKGKALEFLLESLGFGNTNNVFPVYIGDDRTDEDAFKMLRDRGEGFGILVSKFPKDTDASYSLQDPSEVMDFLRRLVEWKQMQPRM

SEQ ID NO: 1047 - DNA, 1090 bp, Gossypium hirsutum
  misc_feature: Ceres CLONE ID no.1846400
  misc_feature: Encodes the peptide sequence at SEQ ID NO 1048
ctcgcttttcacccatcctatcttaaatcaactcgcttccgatccgctggcagacccgtcccagacccgccacgagtggactctcctcttaaccttccagttctgttacctaaattcaactttagaattaccaattaatttcatcgtgttatctaagatgacagacttaaccaagaagaaattagccggaaaagtagccatagtcaccggcggagcaagcggtatcggcgaagccacagcgcgtttgttcgccgagcacggcgcccgtatgaccatcatcgctgatatccaagaccaactcggccaacaagtagctacttcaatcggttcccacaattgtacttacagtcgctgcgacgttaccgatgaaaaccaagtgaaagcattggtcgaattaagtattcaaaagtatggtcaacttgatataatgtttagcaatgctgggattataagtaaatccgatcagagcattcttgatcttgatttccgacagtttgatgggttgatggcggtcaacctccgtggcatgtctgcatgcgttaagcacgcggcgcgtgcgatggtggagaaaaaggtgagaggaagtattgtatgcacggcgagtgtggcggccagccatggaacgaaacggcggacggactattgcatgtcgaagcatggggtgttgggattagttcgattggcgagtaaacagctagggatgtatggtataagggtaaactgtgtgtcgccgaatgggttggcgacgccgatgacatgcgaggtgcatgagaagagtgtggaggaggttgaggaaatctacgaggctggaagggctctgaaaggagcggtgttgagagccgaacacgtggcggatgcagtgctgtttcttgcaagtgatgagtcggagttgattactggccatgacctcgccgtcgacggtggcttccaagcttggtaatttttgcttttgctttcagtaattctttttcttaatcctatggtttttgcagaacattttgacttgattgtattactttgtaattaatatgcttttgtatttttataacttaattattttcttctactctaaaaaaaaaaaaaaaaaaaa

SEQ ID NO: 1048 - protein, 260 aa, Gossypium hirsutum
  misc_feature: Ceres CLONE ID no.1846400
  misc_feature: Bit score of 327.3 for HMM based on sequences of FIGURE 8.
  misc_feature (12)..(181): Pfam Name: adh_short Pfam Description: short chain dehydrogenase
  misc_feature: Functional Homolog Of Ceres SEEDLINE ID no. ME18396 at SEQ ID NO. 1012
MTDLTKKKLAGKVAIVTGGASGIGEATARLFAEHGARMTIIADIQDQLGQQVATSIGSHNCTYSRCDVTDENQVKALVELSIQKYGQLDIMFSNAGIISKSDQSILDLDFRQFDGLMAVNLRGMSACVKHAARAMVEKKVRGSIVCTASVAASHGTKRRTDYCMSKHGVLGLVRLASKQLGMYGIRVNCVSPNGLATPMTCEVHEKSVEEVEEIYEAGRALKGAVLRAEHVADAVLFLASDESELITGHDLAVDGGFQAW

SEQ ID NO: 1049 - DNA, 840 bp, Populus balsamifera subsp. trichocarpa
  misc_feature: Ceres ANNOT ID no.1475185
  misc_feature: Encodes the peptide sequence at SEQ ID NO 1050
atgagttccaatccttcagcatctcccatcagcaaaaggctagaaggcaaggtggcattgataactggtggagctagtggcataggtgagtgcacagcaaggctatttgttcaacacggttccaaggtccttattgcggatgttcaagacgatctcggccgtgctctctgccaagaatacggctctgaggaaatcatctcttatgtccactgcaatgtaacagtcgattctgatgtccaaaatgcggttgatacagctgtttccaggtacggtaagctagacatcatgttcaacaatgctggaatttcaggcaacaccaaatcatctatcttgaattctgataatgaagactttatgagagtccttaatatcaatgtctgtggcggattcttgggtgccaaacatgctgcgagggtgatgattccagctaagaaagggtgcatcctcttcactgcaagtgtggcttcagttctatacggtgaattggcacacgcatatacagcatcgaagaatgctattgtagggttggcgaagaacttgagcgtggacttaggccaacatgggataagagttaatagtatttctcccactgctgttgctaccccaatgcttacagatgctttgagaatgacaaaggaggctgcagagaaatttgttgcatcagcagccaacttaaaagaagcggtattggaaccagaagacgttgcacaagcagccttatatctagccagtgatgactccaagtacgtgagtggggtcaacttggtgatcgatggaggctataaccttaccaatccctcacttgccatggcaatgaaaagcttgttttccaaagtttaa

SEQ ID NO: 1050 - protein, 279 aa, Populus balsamifera subsp. trichocarpa
  misc_feature: Ceres ANNOT ID no.1475185
  misc_feature: Bit score of 515.5 for HMM based on sequences of FIGURE 8.
  misc_feature (17)..(185): Pfam Name: adh_short Pfam Description: short chain dehydrogenase
  misc_feature: Functional Homolog Of Ceres SEEDLINE ID no. ME18396 at SEQ ID NO. 1012
MSSNPSASPISKRLEGKVALITGGASGIGECTARLFVQHGSKVLIADVQDDLGRALCQEYGSEEIISYVHCNVTVDSDVQNAVDTAVSRYGKLDIMFNNAGISGNTKSSILNSDNEDFMRVLNINVCGGFLGAKHAARVMIPAKKGCILFTASVASVLYGELAHAYTASKNAIVGLAKNLSVDLGQHGIRVNSISPTAVATPMLTDALRMTKEAAEKFVASAANLKEAVLEPEDVAQAALYLASDDSKYVSGVNLVIDGGYNLTNPSLAMAMKSLFSKV

SEQ ID NO: 1051 - protein, 274 aa, Oryza sativa subsp. japonica
  misc_feature: Public GI ID no.115457148
  misc_feature: Bit score of 544.7 for HMM based on sequences of FIGURE 8.
  misc_feature (18)..(185): Pfam Name: adh_short Pfam Description: short chain dehydrogenase
  misc_feature: Functional Homolog Of Ceres SEEDLINE ID no. ME18396 at SEQ ID NO. 1012
MAAGSSHVSADARKLVGKVAVITGGASGIGACTARLFVKHGARVVVADIQDELGASLVAELGPDASSYVHCDVTNEGDVAAAVDHAVARFGKLDVMFNNAGVSGPPCFRMSECTKEDFERVLAVNLVGPFLGTKHAARVMAPARRGSIISTASLSSSVSGAASHAYTTSKHALVGFTENAAGELGRHGIRVNCVSPAGVATPLARAAMGMDDEAIEAIMANSANLKGAGALKADDIAAAALFLASDDGRYVSGQNLRVDGGLSVVNSSFGFFRD

SEQ ID NO: 1052 - DNA, 831 bp, Populus balsamifera subsp. trichocarpa
  misc_feature: Ceres ANNOT ID no.1454960
  misc_feature: Encodes the peptide sequence at SEQ ID NO 1053
atgaatgactcttctctaccagctcctcttgccaagaggctagaaggcaaggtagctttgatcacaggagcagctagtggcatcggcgaaaccactgcaagactctttgttcaacatggtgcaaaagttgtaattgccgacatccaagatgagctaggtcactctgtgtgcaatgaaatcggctccgattatgtccactgtgatgttactagcgagattgatgtccaaaatgccgtagagactacaatctcaaagcatggtaagctagatataatgtttagtaatgctggcatagctgacgccaagctcgatataagcatcttagcatttgagcacgaagattacaagaaagttttcgacgtgaatatgtatggtgcattcttgtcagccaagcacgctgcaaaagtaatgatcccggcaaagaagggcagtattatattcacttcaagctttgcttcggtgtgttatggggctatgctcccatacgcatatgctgtgtcaaaacatgctctggttggacttactaagaacttgtgtgtagaattagggcaatatggaattagagttaattgcatttcaccatttggtgtagcaactccattattaaggaaaggattgggagggatcgaccagaagacggtggaggagtttatttgtacatcagcgaacttgaaggaggcagtgctgaaagcaagtgatgtggcagaggcagcactgtatttgggtggtggtgattccaagtatgttagtggactaaatttggttatcgacggtggctatagcaccaccaatgtggccataagagagcaaatgaaagaatatttcggttaa

SEQ ID NO: 1053 - protein, 276 aa, Populus balsamifera subsp. trichocarpa
  misc_feature: Ceres ANNOT ID no.1454960
  misc_feature: Bit score of 498.1 for HMM based on sequences of FIGURE 8.
  misc_feature (17)..(183): Pfam Name: adh_short Pfam Description: short chain dehydrogenase
  misc_feature: Functional Homolog Of Ceres SEEDLINE ID no. ME18396 at SEQ ID NO. 1012
MNDSSLPAPLAKRLEGKVALITGAASGIGETTARLFVQHGAKVVIADIQDELGHSVCNEIGSDYVHCDVTSEIDVQNAVETTISKHGKLDIMFSNAGIADAKLDISILAFEHEDYKKVFDVNMYGAFLSAKHAAKVMIPAKKGSIIFTSSFASVCYGAMLPYAYAVSKHALVGLTKNLCVELGQYGIRVNCISPFGVATPLLRKGLGGIDQKTVEEFICTSANLKEAVLKASDVAEAALYLGGGDSKYVSGLNLVIDGGYSTTNVAIREQMKEYFG

SEQ ID NO: 1054 - DNA, 1257 bp, Triticum aestivum
  misc_feature: Ceres CLONE ID no.936084
  misc_feature: Encodes the peptide sequence at SEQ ID NO 1055
actccaccagcaagagcattattcagtggaagctctcacgctctgcttctgcctccccacgacgccccgccccgcccgtcccgtcccggcaacgaagccggagctccactcccgagacgatgtcggccgccgccggcggcagctcctcctcctccacatcagcgccgcggttggaagggaaggttgcgctggttaccggcggcgcctccggtatcggcgaagccatcgtccgcctcttcagacagcacggcgccaaggtttgcatagcagatgtccaggatgaagccggtcagcagctccgcgactccctcggaggcgaccccgatgtcctgttcgtccactgcgacgtcacagtcgaggaagacataagccgggccgtcgatgcaacagccgagaagtttggcaccctcgacatcatggtcaacaatgccggcattacgggcgacaaggtcaccgatatccggaacctcgactttgctgatgtcaagaaggtgttcgacatcaacgtgcacggcatgctgctgggcatgaagcacgcggcgcgcgtcatgatcccgagcaagaaggggtctattgtctcgttggcgagcgttgccagtgtcatcggagggatggggcctcacgcatacaccgcgtcgaagcacgcagtggtgggtctcaccaagagtgtggcattggagctggggaggcatggcatacgggtgaactgcgtgtcgccgtacgccgtgcccacagcgctctccatgccgcatttgccccagggggagcaaaagggtgatgcagtgagagacttcctggcctttgttggcagtgaggcaaacctgaaaggtgttgatctgctgccgaaggatgtcgccgaggcggtgctctacctggcaagcgacgaagcgaggtacatcagcgcgctcaacctcgtggtcgacggtggatttacatctgtgaatggcaacctgaaggcgtttgaggactagttgaagtctttagctgcatttgttacttggtatctgaaagcatttgagtaccatttctgatttgcctgtgttagcatgtcaataaggtgggtgatcatgtgtaaaattggataattgttctatattagtgcttaaggacagtgctgattattattgatattactctgttgaacctgtgagatgtgacaggaccttgtgtaacattcagttaagagtttcataaagacttctgtggcagtatatctgcgaaatagaaaccagttaacttcgaaaaaaaaaaaaaaaa

SEQ ID NO: 1055 - protein, 283 aa, Triticum aestivum
  misc_feature: Ceres CLONE ID no.936084
  misc_feature: Bit score of 710.7 for HMM based on sequences of FIGURE 8.
  misc_feature (21)..(189): Pfam Name: adh_short Pfam Description: short chain dehydrogenase
  misc_feature: Functional Homolog Of Ceres SEEDLINE ID no. ME18396 at SEQ ID NO. 1012
MSAAAGGSSSSSTSAPRLEGKVALVTGGASGIGEAIVRLFRQHGAKVCIADVQDEAGQQLRDSLGGDPDVLFVHCDVTVEEDISRAVDATAEKFGTLDIMVNNAGITGDKVTDIRNLDFADVKKVFDINVHGMLLGMKHAARVMIPSKKGSIVSLASVASVIGGMGPHAYTASKHAVVGLTKSVALELGRHGIRVNCVSPYAVPTALSMPHLPQGEQKGDAVRDFLAFVGSEANLKGVDLLPKDVAEAVLYLASDEARYISALNLVVDGGFTSVNGNLKAFED

SEQ ID NO: 1056 - protein, 275 aa, Solanum tuberosum
  misc_feature: Public GI ID no.50346893
  misc_feature: Bit score of 624.4 for HMM based on sequences of FIGURE 8.
  misc_feature (14)..(182): Pfam Name: adh_short Pfam Description: short chain dehydrogenase
  misc_feature: Functional Homolog Of Ceres SEEDLINE ID no. ME18396 at SEQ ID NO. 1012
MADTSLPIQRLLGKVALVTGGATGIGESIVRLFHKHGAKVCIADIRDEVGQHVCETLGNDQNVCFIHCDVTVEADVSNAVDFTVQKFGTLDIMVNNAGLSGPPIRDIRDYELSVFENVLDVNLKGAFLGMKHAARIMIPLKKGAIVSLCSVASAIGGIGPHGYAASKYAVLGLTQNVAAEMGKHGVRVNCVSPYAVATGLALAHLPEDEKTDDAMEGFRDFVARNANLQGVELMANDVANAVLFLASDESRYISGHNLMVDGGFSCVNHSLRVFR

SEQ ID NO: 1057 - DNA, 1152 bp, Gossypium hirsutum
  misc_feature: Ceres CLONE ID no.1931526
  misc_feature: Encodes the peptide sequence at SEQ ID NO 1058
aatccattgttgaattttaagaaacaatgtcacactcccaggaattataaagagcagaatcacaaagaggagaaaacacagcatcccaatcattgaaatcaaaagaaaaagcaaaggggagggcctgttttcttcacaaccaccatgagctgcgagtcttcaataaccaagaggctggatggcaaggtggcactgataactggtggtgccagtggcttaggaaagtgcacagccacactatttgtcaaacatggagccaaggttctcattgctgatattcaagacgaattgggcgactctgtttgccaagagcttggaactgaaaacatcagctatgtccactgcgatataacgtgcgaatccgatgttgaaaatgccgtaaacttggctgtctccaagtacggaaagctcgatatcatgttcaacaatgccggcactcttggtgacaacgaagcaagagtgacacacgccagcacggaggacttcaagagagtgttcgatatcaatgtgttgggtggtttcttgggtgccaagtatgctgccagggtcatggttccggccaagaaaggttgcatactattcacttcaagtcttgcttcaaaaatcagcttcggtagcccccatgcatacaaggcatcgaagcatgccgttgcagggttgacgaagagcttggccgtggagttaggtgagcatggaattagagtcaactctatttcacctcatgcaatttcgactccaatgttccaaaaatcaattgggatacccgataagaagaagggagaggagatgattgcggcttcagcagtgttgaaaggcactgtattggagcctgaagattttgcacatgcagcactgtatttggcaagtgatgaggctaaatttattagtggtgtcaacttaccaatcgatggagggtatagtctcagcaatcaatcatggaagctgggattcgcagcactttttggataaaccaccaagtcctctgcttcactctttgaattatagtctcttaaataaggaaaataaaacttatccaaaattacacacatgaaaatttgtattgtcggatttgatcagtctcctgtaatgcttttgaagtgtcctttctttatcaataccacttgctttgctgaaaaaaaaaaaaaaaaaaaa

SEQ ID NO: 1058 - protein, 274 aa, Gossypium hirsutum
  misc_feature: Ceres CLONE ID no.1931526
  misc_feature: Bit score of 498.7 for HMM based on sequences of FIGURE 8.
  misc_feature (14)..(181): Pfam Name: adh_short Pfam Description: short chain dehydrogenase
  misc_feature: Functional Homolog Of Ceres SEEDLINE ID no. ME18396 at SEQ ID NO. 1012
MSCESSITKRLDGKVALITGGASGLGKCTATLFVKHGAKVLIADIQDELGDSVCQELGTENISYVHCDITCESDVENAVNLAVSKYGKLDIMFNNAGTLGDNEARVTHASTEDFKRVFDINVLGGFLGAKYAARVMVPAKKGCILFTSSLASKISFGSPHAYKASKHAVAGLTKSLAVELGEHGIRVNSISPHAISTPMFQKSIGIPDKKKGEEMIAASAVLKGTVLEPEDFAHAALYLASDEAKFISGVNLPIDGGYSLSNQSWKLGFAALFG

SEQ ID NO: 1059 - protein, 370 aa, Arabidopsis thaliana
  misc_feature: Public GI ID no.42568786
  misc_feature: Bit score of 683.5 for HMM based on sequences of FIGURE 9.
  misc_feature (119)..(353): Pfam Name: Trehalose_PPase Pfam Description: Trehalose-phosphatase
  misc_feature: Functional Homolog Of Ceres SEEDLINE ID no. ME20095 at SEQ ID NO. 1129
MVSQNVVVSDAKTGIITVSTVSNSSVFTPTAQKPPTAPGYISVSKKKLLKNLEINGADQSQRLNSWVDSMRASSPTHLKSLSSFSSEEEHNSWIKRHPSALNMFERIIEEARGKQIVMFLDYDGTLSPIVDDPDRAFMTSKMRRTVKKMAKCFPTSIVTGRCIDKVYSFVKLAELYYAGSHGMDIKGPTKGFSRYNKDKPSVLYQPAGDFLPMIDEVYKQLVEKTKSTPGAKVENNKFCLSVHFRCVDEKKWSELASKVRSVVKNYPTLKLSQGRKVFEIRPIIKWNKGKALEFLLESLGFENCNDVFPIYIGDDKTDEDAFKLLRGRGQGFGILVSKFPKDTSASYSLQDPPEVMNFLGRLVEWKQMQQ

SEQ ID NO: 1060 - DNA, 918 bp, Populus balsamifera subsp. trichocarpa
  misc_feature: Ceres ANNOT ID no.1454260
  misc_feature: Encodes the peptide sequence at SEQ ID NO 1061
atgcctggtcaagtgatgcaagagaaaacccttcaaagcattcatgtcatgggaagggaaaagtcgacagaaaacagcactcgctctcctggaagattggagggaagagttgcaatagtcacaggcggtgcgcgaggaattggagaggccactgtaagactttttgcaagacaaggtgccaaagtagtcattgctgatgttgaggatgctcttggaacttcgctcgtaaactcattagccccttcagtttcctttgttcattgtgatgttagcttagaaaaagacattgagaacctgataaactccacgatttctcaatatggtaagttagatattcttttcaacaatgctggggtgcttggaaatcaatcaaagaacaagagcattgttgattttgatgtagacgaatttgaccgtgtcatgcatgtgaatgttagaggaatggcactaggaattaagcacgcagcacgagtgatgattcctagaggaggtgggtgtattatttccacagctagtgtggctggtgtcatgggagggcttggtcctcatgcttacacagcttcaaagcatgccattgttggactcacaaaaaacacagcttgtgagcttggccggtatggaattcgagttaattgcatttctccatttggggtggccacatctatgcttgttaatgcctggagaagtagtggcgaagaggaagattccttgaattttggattgcctagtgaaaaggaagtggagaagatggaggactttgttagagggctggctaacctaaaaggtccaactctaagggctagagatatagctgaagctgctctttatctagctagcgatgaatcaaagtatgtcagtggtcataatcttgttgtggatggtggaatcacaacttcaacaaattgtgttgggttgtaa

SEQ ID NO: 1061 - protein, 289 aa, Populus balsamifera subsp. trichocarpa
  misc_feature: Ceres ANNOT ID no.1454260
  misc_feature: Bit score of 479.2 for HMM based on sequences of FIGURE 8.
  misc_feature (20)..(188): Pfam Name: adh_short Pfam Description: short chain dehydrogenase
  misc_feature: Functional Homolog Of Ceres SEEDLINE ID no. ME18396 at SEQ ID NO. 1012
MGREKSTENSTRSPGRLEGRVAIVTGGARGIGEATVRLFARQGAKVVIADVEDALGTSLVNSLAPSVSFVHCDVSLEKDIENLINSTISQYGKLDILFNNAGVLGNQSKNKSIVDFDVDEFDRVMHVNVRGMALGIKHAARVMIPRGGGCIISTASVAGVMGGLGPHAYTASKHAIVGLTKNTACELGRYGIRVNCISPFGVATSMLVNAWRSSGEEEDSLNFGLPSEKEVEKMEDFVRGLANLKGPTLRARDIAEAALYLASDESKYVSGHNLVVDGGITTSTNCVGL

SEQ ID NO: 1062 - protein, 281 aa, Oryza sativa subsp. japonica
  misc_feature: Public GI ID no.115456131
  misc_feature: Bit score of 707.3 for HMM based on sequences of FIGURE 8.
  misc_feature (19)..(187): Pfam Name: adh_short Pfam Description: short chain dehydrogenase
  misc_feature: Functional Homolog Of Ceres SEEDLINE ID no. ME18396 at SEQ ID NO. 1012
MSAAAAAAASSPAPRLESKVALVTGGASGIGEAIVRLFREHGAKVCIADIQDEAGQKLRDSLGGDQDVLFVHCDVSVEEDVARAVDATAEKFGTLDIMVNNAGFTGQKITDIRNIDFSEVRKVIDINLVGVFHGMKHAARIMIPNKKGSIISLGSVSSVIGGLGPHSYTATKHAVVGLTKNVAGELGKHGIRVNCVSPYAVPTALSMPYLPQGERKDDALKDFFAFVGGEANLKGVDLLPKDVAQAVLYLASDEARYISALNLMVDGGFTSVNHNLRAFED

SEQ ID NO: 1063 - DNA, 1120 bp, Arabidopsis thaliana
  misc_feature: Ceres CLONE ID no.159151
  misc_feature: Encodes the peptide sequence at SEQ ID NO 1064
aaaactccgattgagaggtgtttgcatgattcctgagcttgtctgtgtcaatagtgaggcactacatcgaggaataagaaagaagatctaaggagctaaagctattatgtcaacgaacactgaatcttcttcttattcttctcttcctagtcaaaggcttttgggtaaagtggcattgatcactggaggagccacagggataggtgagagcattgttcgtctgttccacaagcacggtgccaaagtctgcattgttgatctgcaagatgatctcggaggtgaggtgtgtaaaagtctgcttcgtggtgagtccaaggagacggcttttttcatccatggcgatgttagagtggaagatgacattagcaatgcggttgactttgcagtcaaaaattttgggacgcttgatatacttatcaacaatgcaggattatgtggagcaccgtgccctgatattcgtaattatagtttgagtgagttcgagatgacctttgatgtgaatgtgaaaggagcttttctaagcatgaaacatgcagctcgtgtaatgataccggagaagaaagggtcgatagtttccttatgtagtgtgggaggtgttgtgggaggcgttggtccacattcttatgttggttccaagcatgctgttctaggcttgactaggagtgttgcagcggagcttggacagcacgggatacgtgtgaactgtgtttcgccttacgcggttgcaactaaactcgctttggctcatttgccggaggaagaaagaacggaggatgcatttgttggtttcaggaattttgctgctgcaaacgcgaatctaaaaggggtggaactgacggttggtgatgtagcgaacgctgttctgtttttggctagcgatgactcgcggtacataagcggagataatttgatgattgatggaggattcacttgcactaaccactcctttaaagtcttcagatgatgcattttgctaaagaatgttgtttaatgtttattgtccgccaatttatcatgtctatcaaataatttaactgtggagcttattgtggttttaattgttacttttagcattgtagaaatgtttgatgttaactacatttcttactggtagacattg

SEQ ID NO: 1064 - protein, 285 aa, Arabidopsis thaliana
  misc_feature: Ceres CLONE ID no.159151
  misc_feature: Bit score of 585.4 for HMM based on sequences of FIGURE 8.
  misc_feature (21)..(192): Pfam Name: adh_short Pfam Description: short chain dehydrogenase
  misc_feature: Functional Homolog Of Ceres SEEDLINE ID no. ME18396 at SEQ ID NO. 1012
MSTNTESSSYSSLPSQRLLGKVALITGGATGIGESIVRLFHKHGAKVCIVDLQDDLGGEVCKSLLRGESKETAFFIHGDVRVEDDISNAVDFAVKNFGTLDILINNAGLCGAPCPDIRNYSLSEFEMTFDVNVKGAFLSMKHAARVMIPEKKGSIVSLCSVGGVVGGVGPHSYVGSKHAVLGLTRSVAAELGQHGIRVNCVSPYAVATKLALAHLPEEERTEDAFVGFRNFAAANANLKGVELTVGDVANAVLFLASDDSRYISGDNLMIDGGFTCTNHSFKVFR

SEQ ID NO: 1065 - DNA, 1155 bp, Panicum virgatum
  misc_feature: Ceres CLONE ID no.1792501
  misc_feature: Encodes the peptide sequence at SEQ ID NO 1066
atccactctgacttccactctcctccccctcacccccatctttcttgctctcgccgcgacgacgcgcacccgcaccggattcgggcgacgccggcggcaggctccgatctagagacgatgtcagccgcgggctcctcgccgtccgcctcctcctccaccaagcggttggaagggaagtccgccctcgtcaccggtggtgccaccggtattggtgaagccatcgttcgcctcttcagagagcatggcgcgaaggtcggcatcgcggacgtccaggacgaagccggccagcggctgcgcgacgccctcggagaccaggacgtcatgttcgtccactgcgacgtcacggtcgaggaggacgtgagggccgccgtcgacgcggcggccgcgcggttcggcgcgctggacatcatggtgaacaacgccggcatcacgggcaacaaggtcaccgacatccgcaacgtggacttcgccgaggtgcgcaaggtgttcgacatcaacgtgcacggcgtgttcctcgggatgaagcacgcggcgcgcatcatgatcccccagaagcgcggctccatcgtgtcgctggcgagcgtggccagcgtcatcggcgggatgggcccgcacgcgtacaccggctccaagcacgccgtggtcgggctcaccaagagcgtcgccggggagctcgggcgccacggggtgcgcgtcaactgcgtgtcgccctacgccgtgcccacggcgctgtccatgccgcacctgccccagggcgcgcgcgccgacgactccctcaaggacttcctggccttcgtcggcggcgaggccaacctcaagggtgtcgacgtgatgcccagggatgtggccgaggcggtgctctacctggcaagcgacgaggcgaggtacgtcagcgcgctcaacctcatggtggacggcggcttcacagccgtgaaccataacctgaaagcgttcgaggattagctcaagctgttggcagcatttgccagctctggtagtgttgtccctgctgttctgctgcaattcagagatgtggcatgtgctaatatatgtagcagattcgactgtgctgtattcatgtgtctgcaagactaatgtgccagtatatgaatgtctcgcaactgattggatattcaaaaaaaaaaaaaaaaaaaa

SEQ ID NO: 1066 - protein, 281 aa, Panicum virgatum
  misc_feature: Ceres CLONE ID no.1792501
  misc_feature: Bit score of 714.6 for HMM based on sequences of FIGURE 8.
  misc_feature (20)..(187): Pfam Name: adh_short Pfam Description: short chain dehydrogenase
  misc_feature: Functional Homolog Of Ceres SEEDLINE ID no. ME18396 at SEQ ID NO. 1012
MSAAGSSPSASSSTKRLEGKSALVTGGATGIGEAIVRLFREHGAKVGIADVQDEAGQRLRDALGDQDVMFVHCDVTVEEDVRAAVDAAAARFGALDIMVNNAGITGNKVTDIRNVDFAEVRKVFDINVHGVFLGMKHAARIMIPQKRGSIVSLASVASVIGGMGPHAYTGSKHAVVGLTKSVAGELGRHGVRVNCVSPYAVPTALSMPHLPQGARADDSLKDFLAFVGGEANLKGVDVMPRDVAEAVLYLASDEARYVSALNLMVDGGFTAVNHNLKAFED

SEQ ID NO: 1067 - DNA, 843 bp, Populus balsamifera subsp. trichocarpa
  misc_feature: Ceres ANNOT ID no.1437875
  misc_feature: Encodes the peptide sequence at SEQ ID NO 1068
atggccaccgcaagctccactgactcatccctctctcctctaaggttattgggcaaagtagcattggtaacaggtggagctaccggtattggggagagcattgcccggctattttgcagacatggtgcaaaagtttgcatagctgatttgcaagacaaccttggacaaaatgtttgcgagtcgcttggtggtgagccaaaaacttgttatatccattgtgatgtcacaatagaggatgatgttcgccaagctgttgactttactgttgataaatttggaacattggatattatggttaacaatgctgggctgggaggtcccccctgtccagatatccgtaaggtggccttatcagactttgaaaaggtgtttgatgtaaatgtgaagggtgtttttcttggaatgaagcatgcagcacggattatgatccccctaaataagggttcaattgtttctctctgtagtgttgccagtgccatagggggtataggcccacatgcttacacagggtcaaagcatgctgtattgggtctgaccagaagtgttgcagctgaactaggaaaacatgggatacgcgtaaactgtgtctctccttatggagttgcgacaagcttggctgtggctcatttgcccgaggatgagaggactgaggatgccttaataggtttccgctcttttattgggaggaatgctaacttgcaaggtgtggaattgacagttgatgatgtggccaatgccgtgctcttcctagcaagtgatgaagcaaggtacataagtggggataatctaatgcttgatgggggcttcacgtgcacaaaccactcactccgtgtcttcagatga

SEQ ID NO: 1068 - protein, 280 aa, Populus balsamifera subsp. trichocarpa
  misc_feature: Ceres ANNOT ID no.1437875
  misc_feature: Bit score of 707.8 for HMM based on sequences of FIGURE 8.
  misc_feature (19)..(187): Pfam Name: adh_short Pfam Description: short chain dehydrogenase
  misc_feature: Functional Homolog Of Ceres SEEDLINE ID no. ME18396 at SEQ ID NO. 1012
MATASSTDSSLSPLRLLGKVALVTGGATGIGESIARLFCRHGAKVCIADLQDNLGQNVCESLGGEPKTCYIHCDVTIEDDVRQAVDFTVDKFGTLDIMVNNAGLGGPPCPDIRKVALSDFEKVFDVNVKGVFLGMKHAARIMIPLNKGSIVSLCSVASAIGGIGPHAYTGSKHAVLGLTRSVAAELGKHGIRVNCVSPYGVATSLAVAHLPEDERTEDALIGFRSFIGRNANLQGVELTVDDVANAVLFLASDEARYISGDNLMLDGGFTCTNHSLRVFR

SEQ ID NO: 1069 - protein, 369 aa, Arabidopsis thaliana
  misc_feature: Ceres CLONE ID no.255364
  misc_feature: Bit score of 666.7 for HMM based on sequences of FIGURE 9.
  misc_feature (116)..(349): Pfam Name: Trehalose_PPase Pfam Description: Trehalose-phosphatase
  misc_feature: Functional Homolog Of Ceres SEEDLINE ID no. ME20095 at SEQ ID NO. 1129
MTNHNALISDAKGSIGVAVRVPNQSLFSPGGGRYISIPRKKLVQKLEADPSQTRIHTWIEAMRASSPTRTRPGNISPLTESDEEDEYSSWMAQHPSALTMFEEIAEASKGKQIVMFLDYDGTLSPIVENPDRAYMSEEMREAVKGVARYFPTAIVTGRCRDKVRRFVKLPGLYYAGSHGMDIKGPSKRNKHNKNNKGVLFQAANEFLPMIDKVSKCLVEKMRDIEGANVENNKFCVSVHYRCVDQKDWGLVAEHVTSILSEYPKLSLTQGRKVLEIRPTIKWDKGKALEFLLESLGFANSNDVLPIYIGDDRTDEDAFKVLRNKGQGFGILVSKIPKETSATYSLQEPSEVGEFLQRLVEWKQMSLRGR

SEQ ID NO: 1070 - DNA, 1290 bp, Gossypium hirsutum
  misc_feature: Ceres CLONE ID no.1842801
  misc_feature: Encodes the peptide sequence at SEQ ID NO 1071
atctctcattgcctcattctcatcattttctatcaaaacaaactatcctctctttttttatgtcctttcaccatctttaagctaattagctacctaagcttcagtagttagtttttttggcaaaaaatgggggaaagaagcattaaatccaccatttttttgttgaattagcagtcacctgctcaaacagtgacgcccgcaaaagaaaggcaagaggaagctgagaacttactgttgaagtgaagctcctgccatggctactagtagcagcaaccccatagattcatcactgtccagccaaagattagtggggaaagtggcattggtcactggtggagcaaccggcattggtgagagcattgtgcgtctatttcacaagcatggtgccaaagtctgcattgttgatgtgcaagacaaccttggcctccaagtttgtcaatcccttggcaacggccccaacgtttgttttttccattgcgacgtgacgatagaagaacaagttcgggccgcggtcgactacgcagttgaaaagtttggtacactcgatatcatggtcaacaatgccgggttatcaggtccaccgtataacgatatccgcaactatgacttatctgatttcgagaaagtaatgaatgtgaatgtaaaaggtgttttccttggaatgaaacatgctgctagaattatgatcccacatgaaaagggttcaatcatttcaacctgtagtgtttcaggtgtcatcggtggcctaggacctcatgcatatacaggctctaaacatgctgttttaggccttactaggaatgttgcatctgagttaggcaaatacgggatacgagtgaattgtgtttctccgtatgccgtcgcaaccgaattggcctttgctcacttgcacgaggacgaaagaactgaagatgtacgaaccggttttcgtgctttcatcgggaaaaacgcgaacctgaatggggtggatttgactgtggagcatgtggctaatgctgtgctgttcttagcaagtgatgatgcagggtatataagtggagacaatcttatggttgatggtgggtttacatcttccaatcactcattgcgtgtcttcagatgaggattgatgaaaatatgaaccaaaatgaggctcattagctttggttcaactattaccagattgtatttcccttctattttctcctgtcactggtatgtaatttgtaacaaaaaacttctaatataattttaattatatctatatataaaatatcatatgctttaatacaaaaaaaaaaaaaaaaaaaa

SEQ ID NO: 1071 - protein, 282 aa, Gossypium hirsutum
  misc_feature: Ceres CLONE ID no.1842801
  misc_feature: Bit score of 625.7 for HMM based on sequences of FIGURE 8.
  misc_feature (21)..(189): Pfam Name: adh_short Pfam Description: short chain dehydrogenase
  misc_feature: Functional Homolog Of Ceres SEEDLINE ID no. ME18396 at SEQ ID NO. 1012
MATSSSNPIDSSLSSQRLVGKVALVTGGATGIGESIVRLFHKHGAKVCIVDVQDNLGLQVCQSLGNGPNVCFFHCDVTIEEQVRAAVDYAVEKFGTLDIMVNNAGLSGPPYNDIRNYDLSDFEKVMNVNVKGVFLGMKHAARIMIPHEKGSIISTCSVSGVIGGLGPHAYTGSKHAVLGLTRNVASELGKYGIRVNCVSPYAVATELAFAHLHEDERTEDVRTGFRAFIGKNANLNGVDLTVEHVANAVLFLASDDAGYISGDNLMVDGGFTSSNHSLRVFR

SEQ ID NO: 1072 - DNA, 468 bp, Glycine max
  misc_feature: Ceres CLONE ID no.533030
  misc_feature: Encodes the peptide sequence at SEQ ID NO 1073
tgccaatgccatgcaggcttgatgggaaggtggcgattatcactggtggtgcgagtggtctaggtgcagccactgcaagactcttctctaagcatggagcatatgtagtcatagctgatattcaagacgacttgggtctctctgttgccaaagagttagaatctgcttcctatgtccattgcgatgtgacaaaggaagaggacgttgaaaactgcgtgaacacaacggtttccaagtatggcaaattagatatcatgtttaacaatgcaggtgtatctgatgagatcaaaacaagcattcttgacaacaacaagtctgattttgagagagtgataagtgttaacttggttggtccttttctgggaacaaagcatgctgcaagggtcatgattcctgctaaaaagggatgcataatcaacacagctagtgttgctggatgcataggtggaggtgctacacatgscctac

SEQ ID NO: 1073 - protein, 154 aa, Glycine max
  misc_feature: Ceres CLONE ID no.533030
  misc_feature: Bit score of 217.9 for HMM based on sequences of FIGURE 8.
  misc_feature (8)..(149): Pfam Name: adh_short Pfam Description: short chain dehydrogenase
  misc_feature: Functional Homolog Of Ceres SEEDLINE ID no. ME18396 at SEQ ID NO. 1012
  misc_feature (153)..(153): Xaa is any aa, unknown, or other
MPCRLDGKVAIITGGASGLGAATARLFSKHGAYVVIADIQDDLGLSVAKELESASYVHCDVTKEEDVENCVNTTVSKYGKLDIMFNNAGVSDEIKTSILDNNKSDFERVISVNLVGPFLGTKHAARVMIPAKKGCIINTASVAGCIGGGATHXL

SEQ ID NO: 1074 - DNA, 1090 bp, Gossypium hirsutum
  misc_feature: Ceres CLONE ID no.1931881
  misc_feature: Encodes the peptide sequence at SEQ ID NO 1075
acagcatcccaagcattgcaatcaaaagaaaaagcaaaggcgagggtctattttcttcacaaactacaatgggttccgagtctttagtaaccaagagactagatggtaaggtggcactgataactggtggtgccagtggcttaggagagtgttcagccaggctatttctcaaacatggagccaaggttctgattgctgatattcaagacgaattgggccactccctttgccaagagctcggaactgaaaacttcagccatgtccattgtgatgtaacatgcgaatctgatgtcgaaaatgccgtaaacttagcagtctccaagtttggaaaactcgatatcatgttcaacaatgctggccttattggtgatggtgaagtcagagtgacagacgccagcactgacaacttcaagagagtgttcgatatcaatgtcttgggtggtttcttgggagccaagtatgcagccaaggtcatggttccggccaagaaaggttgcattctcttctcgtcgagtatttcttcaaaaatcagcatcggtctgccccatgcatacaaggcatcgaagcatggcgtcgtagggttgacgaagagcttggccgtggagttaggtgagcatggaattagagttaattgcatttcacctcacgcaactgtgaccccattgttccaaacaacactggggttgttcgataagaagaagggagaggagatgattgcggcttcagctgtgttgaaaggcaccgtattggaacctgaagattttgcacatgcagcactgtatttggcaagcgatgaggctaaattcatcagtggtgttaacgtgcctgtcgatggagggtataatctcagtaaccagtcatggaagatgggatttgcagcactttttggataaatcaacaagtcctctattttaatctttgaacaatattttcttcaatagggagaataaaaattacccaagattaaagtacttgtaataaattgtactgtcgatcggtctgtgatgtatgctttcttcatcaatatgcaattatagcacgtgttacctgcagtctctgaggaaaacaagacgtgctaatttgaattttc

SEQ ID NO: 1075 - protein, 274 aa, Gossypium hirsutum
  misc_feature: Ceres CLONE ID no.1931881
  misc_feature: Bit score of 479.9 for HMM based on sequences of FIGURE 8.
  misc_feature (14)..(181): Pfam Name: adh_short Pfam Description: short chain dehydrogenase
  misc_feature: Functional Homolog Of Ceres SEEDLINE ID no. ME18396 at SEQ ID NO. 1012
MGSESLVTKRLDGKVALITGGASGLGECSARLFLKHGAKVLIADIQDELGHSLCQELGTENFSHVHCDVTCESDVENAVNLAVSKFGKLDIMFNNAGLIGDGEVRVTDASTDNFKRVFDINVLGGFLGAKYAAKVMVPAKKGCILFSSSISSKISIGLPHAYKASKHGVVGLTKSLAVELGEHGIRVNCISPHATVTPLFQTTLGLFDKKKGEEMIAASAVLKGTVLEPEDFAHAALYLASDEAKFISGVNVPVDGGYNLSNQSWKMGFAALFG

SEQ ID NO: 1076 - DNA, 930 bp, Populus balsamifera subsp. trichocarpa
  misc_feature: Ceres ANNOT ID no.1480006
  misc_feature: Encodes the peptide sequence at SEQ ID NO 1077
atgctggctcaagtgataccagagcaaacccttcaagttcaagggattgatcatgtcataggcaaggataactcctcatctctctcatataaaaggttggagggaaaagttgcgattataacaggcggtgcaagagggattggagaggccacagtgaaactctttgtgaggcatggagccaaggtagtgattgctgatattgaggatgctaatggtattgctttagctgaatctttatctccttcagcagtttatgtacgttgtgatgtgtgtttagaagaagaaatagaaagtctaatcaacctaacaatttctcaatacggccggctggacattcttttcaacaatgctggagttcttggcaatcaatcaaagcacaaaagcattatcaattttgatgctgatgagtttgataatatcatgagaatcaatgttagaggagctgcccttggcatgaaacatgcagcaagagtcatggtgcctcgacgaagtggctgcgtcatttccacagctagtgtagctggtataattggagggcttggacctcatgcatatacagcttcaaaacatgctattgtagggttaacaaagaacacagcttgtgaattaagcagatatgggattagggttaattgtatatctcctttcggggtggctacttccatgcttgttaatgcatggaggggttgcgaggaagatggagatgatgatgagaaatgcatggattttggtgctccaagcgaggaagaaatggagaagatggaggaacttgtgagagggcttggaaatctaaagggagcaacactaaaagctaaggatattgccgaggctgctctttatcttgctagtgatgaatccaagtatgtaagtggtcacaatcttgttgtagatggtggttttactaccttcaaaaactgcgtaggactgtag

SEQ ID NO: 1077 - protein, 309 aa, Populus balsamifera subsp. trichocarpa
  misc_feature: Ceres ANNOT ID no.1480006
  misc_feature: Bit score of 463.0 for HMM based on sequences of FIGURE 8.
  misc_feature (36)..(204): Pfam Name: adh_short Pfam Description: short chain dehydrogenase
  misc_feature: Functional Homolog Of Ceres SEEDLINE ID no. ME18396 at SEQ ID NO. 1012
MLAQVIPEQTLQVQGIDHVIGKDNSSSLSYKRLEGKVAIITGGARGIGEATVKLFVRHGAKVVIADIEDANGIALAESLSPSAVYVRCDVCLEEEIESLINLTISQYGRLDILFNNAGVLGNQSKHKSIINFDADEFDNIMRINVRGAALGMKHAARVMVPRRSGCVISTASVAGIIGGLGPHAYTASKHAIVGLTKNTACELSRYGIRVNCISPFGVATSMLVNAWRGCEEDGDDDEKCMDFGAPSEEEMEKMEELVRGLGNLKGATLKAKDIAEAALYLASDESKYVSGHNLVVDGGFTTFKNCVGL

SEQ ID NO: 1078 - DNA, 1261 bp, Gossypium hirsutum
  misc_feature: Ceres CLONE ID no.1895007
  misc_feature: Encodes the peptide sequence at SEQ ID NO 1079
cttctccatctctcattgcctcattgtcaccattttctatcaaaacaaactaccctctctttttttttatgtcctttctccatctttaagctaattggctacttaagcttcagtagttaagtttttttagcaaaaaatgggggaaagaagcattaaatccaccatttttttgttgaattagcagtcacctgctcaaacagtgatattgttgaagtgaaactcctgccatggctactagcagcaacaactccatagattcatcactgtccagccaaagattagtggggaaagtggcattggtcactggtggagcaaccggcattggtgagagcattgtgcgtctatttcacaagcatggtgccaaagtctgcattgttgatgtgcaagacaaccttggcctccaagtttgtcaatccctcagcaacggccctaacgtatgttttttccattgcgacgtgacaatagaagaacaagttcggaccgcggttgactacgcagttgaaaagtttggtacactcgatatcatggtcaacaacgccggattatcaggtccaccgtataacgatatccgcaactatgacttatctgatttcgataaagtaatgaatgtgaatgtaaaaggtgttttccttggaatgaagcatgctgctagaattatgatcccacatgaaaagggttcaatcatttcaatctgtagtgtttcaggtgtcatcggtggcctaggacctcatgcatatacaggctctaaacatgctgttttaggccttactaggaatgttgcatctgagttaggtaaatacggaataagagtgaattgtgtttctccgtatgccgttgcaaccgaattggcctttgctcacttgcacgaggacgaaagaaccagcgatgtacgtactggttttcgtgctttcatcgggaaaaacgcgaacctggatggggtggatttgactgtggagcatgtggctaatgctgtgctgttcttagcaagtgatgatgcagggtacataagtggagacaatcttatggttgatggtgggtttacatcttccaatcactcattgcgtgtctttagatgaggattgatgaaaatgtgaaccaaaatgaggctcattagcttagctgcctaagccactagctttggttcaactattaccagattgtatctcccttctattttctcctgtcagtggtatgtaatttgtgacaaaaaaacttctaatataattttaattatattaaacaaaaaaaaaaaaaaaaaaaa

SEQ ID NO: 1079 - protein, 282 aa, Gossypium hirsutum
  misc_feature: Ceres CLONE ID no.1895007
  misc_feature: Bit score of 609.9 for HMM based on sequences of FIGURE 8.
  misc_feature (21)..(189): Pfam Name: adh_short Pfam Description: short chain dehydrogenase
  misc_feature: Functional Homolog Of Ceres SEEDLINE ID no. ME18396 at SEQ ID NO. 1012
MATSSNNSIDSSLSSQRLVGKVALVTGGATGIGESIVRLFHKHGAKVCIVDVQDNLGLQVCQSLSNGPNVCFFHCDVTIEEQVRTAVDYAVEKFGTLDIMVNNAGLSGPPYNDIRNYDLSDFDKVMNVNVKGVFLGMKHAARIMIPHEKGSIISICSVSGVIGGLGPHAYTGSKHAVLGLTRNVASELGKYGIRVNCVSPYAVATELAFAHLHEDERTSDVRTGFRAFIGKNANLDGVDLTVEHVANAVLFLASDDAGYISGDNLMVDGGFTSSNHSLRVFR

SEQ ID NO: 1080 - protein, 284 aa, Ipomoea trifida
  misc_feature: Public GI ID no.3598863
  misc_feature: Bit score of 451.8 for HMM based on sequences of FIGURE 8.
  misc_feature (17)..(184): Pfam Name: adh_short Pfam Description: short chain dehydrogenase
  misc_feature: Functional Homolog Of Ceres SEEDLINE ID no. ME18396 at SEQ ID NO. 1012
MAASSLQLPVFKRLEGKVAIITGAANGIGATTARLFAQHGCKVIIADIDDKNGHSVAEEIGPEYALFIHCDVRIESHVQHAVDTTVSRYGKLDIMFSNAGVAGSRDTSILEASPENINLVFETNVFGAFFCAKHAARVMIPARKGSVIFSASAASEVFGITSDTYTASKCAVVGLCKSLCVEMGKYGIKANCVSPYVILTKLGMSIMPTQDRKLAEEIVAEASNFKGKTLTTEDVAEAALYLAGDESKFVSGLNLLIDGGFTTTNIAFQVAVEKVLGGGEGTTA

SEQ ID NO: 1081 - DNA, 1173 bp, Populus balsamifera subsp. trichocarpa
  misc_feature: Ceres ANNOT ID no.1471735
  misc_feature: Encodes the peptide sequence at SEQ ID NO 1082
atgaataatgattcacccgtcacgtatgttgtcttgcaaatgggccctatagtctcagtgtcaactgtcaacccctcgagtccctttttctctcactgtctctcgtgcttgagcaaaagcttctcacacagaacacctctttgtggttcaaactttctctcccaccaggtgcagtatgttcaagattggattcagaagagcttccatttcaagatcagtttctcttgctcaggtcttcaacaagggattctcctcccagcctggaagataaaaaatactccgaaaaagaataaccagcatgataccaagcatcttcttgcacaagatcctcctccgccacgagaaaagtattttagttcaacttttcactattcaagcaaactagaaggtaaggtagcattgatcactggagcagcaagtggaattggaaaggcaactgcagccaaattcataaaccatggtgccagagttgttattgctgatattcaacaccaactaggccaagaaactgcaaatgaacttgggccagacgctactttcatttcctgtgatgtaactaaagaatctgatgtttccggtgctgttgattttgccatctctaagtacaaccaactggatattttgtacaacaacgcaggggtggcctgcaagagtcctcatagtattgtagaccttgatctagctgtgtttgataggatcatgaatatcaatgtacggggagtaatggctggagttaaacatgcatcgcgtgtgatgatcccacgaaggagtggcgccattctttgcacagctagcatcacaggtctcatgggtgggcttgcgcagcacacctacagcgtctccaagtttgctgttgcaggcattgtcaagtcacttgcagcagagttatgcaagcatgggattcggataaactgcatatcgccctttgctattccaactccatttgtgatggaagaaatgaggcagatatatcctggtgctgatgatgaaaagctcgtggaaattctgtatagaaccggtacattagagggagcaaattgtgagccaaatgatatagctaatgctgcactctaccttgcatccgatgatgccaagtatgttagcggacataatttggtggtagatggaggttttacatcattcaagaatccgatgctccccgcatcaatttag

SEQ ID NO: 1082 - protein, 377 aa, Populus balsamifera subsp. trichocarpa
  misc_feature: Ceres ANNOT ID no.1471735
  misc_feature: Bit score of 388.7 for HMM based on sequences of FIGURE 8.
  misc_feature (118)..(284): Pfam Name: adh_short Pfam Description: short chain dehydrogenase
  misc_feature: Functional Homolog Of Ceres SEEDLINE ID no. ME18396 at SEQ ID NO. 1012
MGPIVSVSTVNPSSPFFSHCLSCLSKSFSHRTPLCGSNFLSHQVQYVQDWIQKSFHFKISFSCSGLQQGILLPAWKIKNTPKKNNQHDTKHLLAQDPPPPREKYFSSTFHYSSKLEGKVALITGAASGIGKATAAKFINHGARVVIADIQHQLGQETANELGPDATFISCDVTKESDVSGAVDFAISKYNQLDILYNNAGVACKSPHSIVDLDLAVFDRIMNINVRGVMAGVKHASRVMIPRRSGAILCTASITGLMGGLAQHTYSVSKFAVAGIVKSLAAELCKHGIRINCISPFAIPTPFVMEEMRQIYPGADDEKLVEILYRTGTLEGANCEPNDIANAALYLASDDAKYVSGHNLVVDGGFTSFKNPMLPASI

SEQ ID NO: 1083 - DNA, 938 bp, Gossypium hirsutum
  misc_feature: Ceres CLONE ID no.1937530
  misc_feature: Encodes the peptide sequence at SEQ ID NO 1084
agcaaatccgagggcctcgctaaaagacttttcagatgtctaacccaaggttggaaggtaaggtggctcttatcactggtggagccagcggtatcggtgaggagacggcgaggttctttgtacaacatggggctttggttgttattgttgatgtccaggatgatctggggaatcaagtcgctgcatcgatcggccttgacaaggttagttaccggcactgcgatgtacgagaggagaagcaggttgaggaagcagtaagtttcacagtggagaaatatgggaagctggatatcttattcagcaatgcgggtaccctaggctcgttaaccggaatcttagaaattgacctggatgactttgacaacaccatagccacgaacgttcgaggggtggccgccacgatcaagcatgccgctcgagctatggtggctaaaaacacacgcggatccatcatatgcactggaagtgtagcatcttttgtaggaggaactggtcccaatggttatacaacatcaaagcatgctatcgtagggcttgttcgaggagcgtgtagtgagctaggggctcatgggatccgagtcaattgcgtttctccctacggagttgccacgccgctcgcttgtagagcctacaattttgaaccaagtcaactggaggccaacagttattcggcaagcaacttgaaaggtattgtgttgaaggctagacacgttgcagagactgtgttatttcttgcttctgatgagtccgcttatattagcggccaaaacttggctgttgatggaggatttactgtggttactcacagtctttcaacatttaccgattaatggttgtggaagccaatttttgatataattctctgtaacatttatcagtaaagtttcttcgacttgcgagtccaaccttattaccagtaaaaaaaaaaaaaaaaaaaa

SEQ ID NO: 1084 - protein, 264 aa, Gossypium hirsutum
  misc_feature: Ceres CLONE ID no.1937530
  misc_feature: Bit score of 412.4 for HMM based on sequences of FIGURE 8.
  misc_feature (9)..(176): Pfam Name: adh_short Pfam Description: short chain dehydrogenase
  misc_feature: Functional Homolog Of Ceres SEEDLINE ID no. ME18396 at SEQ ID NO. 1012
MSNPRLEGKVALITGGASGIGEETARFFVQHGALVVIVDVQDDLGNQVAASIGLDKVSYRHCDVREEKQVEEAVSFTVEKYGKLDILFSNAGTLGSLTGILEIDLDDFDNTIATNVRGVAATIKHAARAMVAKNTRGSIICTGSVASFVGGTGPNGYTTSKHAIVGLVRGACSELGAHGIRVNCVSPYGVATPLACRAYNFEPSQLEANSYSASNLKGIVLKARHVAETVLFLASDESAYISGQNLAVDGGFTVVTHSLSTFTD

SEQ ID NO: 1085 - DNA, 963 bp, Gossypium hirsutum
  misc_feature: Ceres CLONE ID no.1833050
  misc_feature: Encodes the peptide sequence at SEQ ID NO 1086
gtgagcttaacggagaaaacagcagaacccagggggcgccttataaaaaaaagttgtagcaggcaggcaggtaggctcactcagatgtctaagtcaaggttggaaggtaaggtagctcttatcactggtgccgccagcgggattggtgaggagacggtgaggttatttgtggaacatggggcttttgttatcattgctgatgtccaagatgatctcgggaacaaagtcgcggcatccatcggcctagacaaggttagttactgtcactgtgacgtaagagacgagaagcaggtagaggcaacagtgagttacgcggtggagaaatatggaaggctggacattttgttcagcaatgctggtgtctatggaccgttacctgggatcttggaacttgacgttaatggcttcgacaacaccatggccacaaatgttcgaggtgttgcagccacgatcaagcatgccgctcgtgctatggtggctaaaaacatacgcggatccatcatatgcactgcgagtgtagcatcttgtgtaggaggaatcgcaacgattggttatacgacatcgaaacatgctgttgtaggacttgttcgaggagcatgtagtgagctagggggttacgggatcagagtaaattgcgtttctccatttggagtggccacgcctcttgcttgtaaaattttcgatatggaaccaagtgaagtagaggccaatacttgttccaggagcaacttgaaaggtattgtgttgaaggctagacacatttcggaggctgcattgtttcttgcttctgatgaatccgtttacatcagtggccaaaacttggcagttgatggaggcttttcagtggttaattacagttttccagaagttcataactaatgctagtcatcactgttagaacgcaatatttaataaagattggccattaattcggctcctatttaaaaaaaaaaaaaaaaaaaa

SEQ ID NO: 1086 - protein, 264 aa, Gossypium hirsutum
  misc_feature: Ceres CLONE ID no.1833050
  misc_feature: Bit score of 396.6 for HMM based on sequences of FIGURE 8.
  misc_feature (9)..(176): Pfam Name: adh_short Pfam Description: short chain dehydrogenase
  misc_feature: Functional Homolog Of Ceres SEEDLINE ID no. ME18396 at SEQ ID NO. 1012
MSKSRLEGKVALITGAASGIGEETVRLFVEHGAFVIIADVQDDLGNKVAASIGLDKVSYCHCDVRDEKQVEATVSYAVEKYGRLDILFSNAGVYGPLPGILELDVNGFDNTMATNVRGVAATIKHAARAMVAKNIRGSIICTASVASCVGGIATIGYTTSKHAVVGLVRGACSELGGYGIRVNCVSPFGVATPLACKIFDMEPSEVEANTCSRSNLKGIVLKARHISEAALFLASDESVYISGQNLAVDGGFSVVNYSFPEVHN

SEQ ID NO: 1087 - DNA, 1097 bp, Glycine max
  misc_feature: Ceres CLONE ID no.644213
  misc_feature: Encodes the peptide sequence at SEQ ID NO 1088
acatcaacagctttatttccaggttttggggagagttcatccaagcaaggaactcactcattcactcactagtcactaccaatgccgaaacaaaggttggagggtaaggtggctcttatcactggagcagcaagtgggattggagaagagacagtgagattgttcgctgaacatggagcacttattgttgcagcagatattcaagatgaacaaggccaccaagttgcagcttcaatagggtcagagagagtgacctaccaccattgtgatgtgagagatgaaaaccaagttgaagaaacaatcaagttcactttggaaaaacatggtcgcatagatgttttgttcagcaacgcgggaataataggttccttatctgggatccttgaccttgatctgaatgagtttgacaacacaattgccacaaatgttcgcggtgtagccgccacgattaagcacacggcacgtgccatggttgctaaaagcacccgtggatccatcatatgcaccacaagtgtggctgctatgattggtggaactggacctcatggctataccacatcaaaacatgctcttctggggttggtgaaatcagcttgtagtgaacttggtgcttatggaataagagttaatagcatatccccttttggagttgcaacacctcttgcatgcaaagctttcaactttgaacctgagcaagttgaagctaatagctgctcacaggctaatctaaaaggtgttgtgttgaaggctaggcatatagctgaagcagctttgtttcttgcttctgatgatgctgtttacatcagtggtcacaacttggtggtggatggtggcttctctatggttaatagaagttattccttcacaccagcttaattacatgtagagccaaaaaaactatagttttgtggctgattggcattaatttctttatcctcatcaagtagagaacatatatgatgtcatgcagtgcgtcaaattaccttgttactgggactttttttttttcatttgcactctactaataattctgcagtgtatcttctttgtttgtattttcaaagcataaattcatcaaccttgtctgcttgtgaccc

SEQ ID NO: 1088 - protein, 264 aa, Glycine max
  misc_feature: Ceres CLONE ID no.644213
  misc_feature: Bit score of 379.8 for HMM based on sequences of FIGURE 8.
  misc_feature (9)..(176): Pfam Name: adh_short Pfam Description: short chain dehydrogenase
  misc_feature: Functional Homolog Of Ceres SEEDLINE ID no. ME18396 at SEQ ID NO. 1012
MPKQRLEGKVALITGAASGIGEETVRLFAEHGALIVAADIQDEQGHQVAASIGSERVTYHHCDVRDENQVEETIKFTLEKHGRIDVLFSNAGIIGSLSGILDLDLNEFDNTIATNVRGVAATIKHTARAMVAKSTRGSIICTTSVAAMIGGTGPHGYTTSKHALLGLVKSACSELGAYGIRVNSISPFGVATPLACKAFNFEPEQVEANSCSQANLKGVVLKARHIAEAALFLASDDAVYISGHNLVVDGGFSMVNRSYSFTPA

SEQ ID NO: 1089 - DNA, 1210 bp, Triticum aestivum
  misc_feature: Ceres CLONE ID no.568154
  misc_feature: Encodes the peptide sequence at SEQ ID NO 1090
aaaccagcaagcttcacacacttccttccttcctgttgtggctcctgtacatgcgcgctagcctcgcctcgtacgcgcaagacctcgccatgcctgccttggacgtcatgccggagaaggcccaccacccggccatgtcgccgtcgcaccacggccacgggtgggacgccagcggcgcccccacccccatgcacaagaggctggacggcaaggtggccattgtcaccggcggcgcgcggggcatcggggaggccatcgtcaggctcttcgtcaagcacggcgccaaggtggtcatcgcggacatcgacgacgccgccggcgaggcgctggccgcctcgctcggcccgcacgtcgccttcgtgcgctgcgacgtgtccgtggaggaggacgtggagcgcgccgtcgaccgcgccgtgtcgcgctacggccgcctcgacgtcttctgcaacaacgccggggtgctgggccgccagaccagcgccgccaagagcatcctcacgttcgacgccggcgagttcgaccgcgtgctccgcgtcaacgcgctgggcaccgcgctcggcatgaagcacgccgggcgcgccatgatggcccgccgctacggcagcatcgtctccatcgccagcgtcgccggcgtgctcggcggcctcggcccgcacgcatacaccgcctccaagcacgccatcgtggggctcaccaagaacgccgcctgcgagctgggcgcgcacggcatccgcgtcaactgcgtctcgcccttcggcgtcgccaccccaatgctcatcaacgcgtggcgccagggccacgacgcgtccgccgccgacgacgccgacgccgacatcggcctcgacgtggccgcgccgagcgaccaggaggtggagaagatggaggaggtggtgaggagcctcgccacgctcaaggggtccaccctcaggcccagggacatcgccgaggcggtgctcttcctggccagcgacgactccagatacgtgtccggccacaacctcgtggtggacggcggcgtcaccacctcaagaaacttgatcgggctgtgaaaatcgcatggccgacctcgcatcaaggcacctacgtaatgtagatcagtaggaggaacaaggacgattgtttagtctgcaataactgtacgcaagttctttggttggttcggttaattggttgattgattcagtgtgctattcgaaaaaaaaaaaaaaaa

SEQ ID NO: 1090 - protein, 332 aa, Triticum aestivum
  misc_feature: Ceres CLONE ID no.568154
  misc_feature: Bit score of 423.9 for HMM based on sequences of FIGURE 8.
  misc_feature (54)..(223): Pfam Name: adh_short Pfam Description: short chain dehydrogenase
  misc_feature: Functional Homolog Of Ceres SEEDLINE ID no. ME18396 at SEQ ID NO. 1012
MRASLASYAQDLAMPALDVMPEKAHHPAMSPSHHGHGWDASGAPTPMHKRLDGKVAIVTGGARGIGEAIVRLFVKHGAKVVIADIDDAAGEALAASLGPHVAFVRCDVSVEEDVERAVDRAVSRYGRLDVFCNNAGVLGRQTSAAKSILTFDAGEFDRVLRVNALGTALGMKHAGRAMMARRYGSIVSIASVAGVLGGLGPHAYTASKHAIVGLTKNAACELGAHGIRVNCVSPFGVATPMLINAWRQGHDASAADDADADIGLDVAAPSDQEVEKMEEVVRSLATLKGSTLRPRDIAEAVLFLASDDSRYVSGHNLVVDGGVTTSRNLIGL

SEQ ID NO: 1091 - DNA, 999 bp, Glycine max
  misc_feature: Ceres CLONE ID no.527598
  misc_feature: Encodes the peptide sequence at SEQ ID NO 1092
atccttcacgaccacataagcaattaattaagcactctaaaacatatatttatttccttgtctacatatatcttgaaaaactcaatcatggctagtgtttcttcggtttcagctccatttagaaggcttgaggggaaggtggcgattatcactggtggtgcgagtggtctaggtgcagccactgcaagactcttctctaagcatggagcacatgtagtcatagctgatattcaagacgacttgggtctctctgttgccaaagagttagaatccgcttcctatgtccattgcgatgtcacaaacgaaaacgacgttgaaaactgtgtgaacacagcggtttccaagtatggcaaactcgatatcatgtttaataatgctggcataattgatgagatcaaaacaagcatagttgacaacagcaagtctgattttgagagagtgataggtgttaacttggttggtccttttctgggaacaaagcatgctgcaagggtcatgattcctgctaaaaagggatgcataatcaacacagctagtgttgctggatgcataggtggaggtgctacacatgcctacacaagttcaaagcacgcactaattgggctgacaaaaaacactgcggtggagcttggacaacatggtattagggtaaattgtttgtctccttatcttgttgtcacaccattaagtaagaaatatttcaatattgatgaagacaaaattcgtgagatatattcaaacctaaaaggtgctcatcttgtgcctaacgatgtggccgaagctgctctttacttggcaggtgatgagtccaagtatgttagtggtcacaatcttgtgatagatggagggtacactgatgtaaatgcaggatttaccgtgtttgggcagtctcagtaaaaattgtctgtgtctttaaagtttaaataattattgttggtgtttgaagtgtctgtgtttcgatggccctgtagttcagaaacttgagctgttagcatgtgt

SEQ ID NO: 1092 - protein, 269 aa, Glycine max
  misc_feature: Ceres CLONE ID no.527598
  misc_feature: Bit score of 673.8 for HMM based on sequences of FIGURE 8.
  misc_feature (17)..(182): Pfam Name: adh_short Pfam Description: short chain dehydrogenase
  misc_feature: Functional Homolog Of Ceres SEEDLINE ID no. ME18396 at SEQ ID NO. 1012
MASVSSVSAPFRRLEGKVAIITGGASGLGAATARLFSKHGAHVVIADIQDDLGLSVAKELESASYVHCDVTNENDVENCVNTAVSKYGKLDIMFNNAGIIDEIKTSIVDNSKSDFERVIGVNLVGPFLGTKHAARVMIPAKKGCIINTASVAGCIGGGATHAYTSSKHALIGLTKNTAVELGQHGIRVNCLSPYLVVTPLSKKYFNIDEDKIREIYSNLKGAHLVPNDVAEAALYLAGDESKYVSGHNLVIDGGYTDVNAGFTVFGQSQ

SEQ ID NO: 1093 - protein, 267 aa, Vigna unguiculata
  misc_feature: Public GI ID no.1853968
  misc_feature: Bit score of 697.5 for HMM based on sequences of FIGURE 8.
  misc_feature (17)..(182): Pfam Name: adh_short Pfam Description: short chain dehydrogenase
  misc_feature: Functional Homolog Of Ceres SEEDLINE ID no. ME18396 at SEQ ID NO. 1012
MANGSVLSPVVKRLEGKVAIITGGASGIGEATARLFSQHGAHVVVADIQDDVGLSLCNELKSAIYVHCDVTKEEDIEKCVDTAVSKFGKLDIMFNNAGTGDEFKKSILDNTKSDFERVISVNLVGPFLGTKHAARVMIPARRGCIINTASVAGCIGGGATHAYTSSKHALVGLTKNTAVELGQFGIRVNCVSPFAIVTPLLNKYFNLDEEGVRKTYMNLKGWYPVPNDVAEAALYLASDESKFVSSHNLVIDGGLINSNVGFPMFEM

SEQ ID NO: 1094 - protein, 274 aa, Phaseolus lunatus
  misc_feature: Public GI ID no.27530032
  misc_feature: Bit score of 670.2 for HMM based on sequences of FIGURE 8.
  misc_feature (17)..(182): Pfam Name: adh_short Pfam Description: short chain dehydrogenase
  misc_feature: Functional Homolog Of Ceres SEEDLINE ID no. ME18396 at SEQ ID NO. 1012
MAHVSAVSAAVKRLEGKVAIITGGASGIGAATARLFSEHGAHVVIADIQDDLGLSVCNELKSAVYVHCDVTKEEDVEKCVNVTVSKYGKLDIMLNNAGTCHELKDSIVDNITSEFERVISVNVVGPFLGTKHAARVMIPAKRGCIINTSSIAGCRGTGSPHAYVVSKHGLEGLTKNTAVELGQFGIRVNCVSPYLVATPMLKKYFNLDEEGVREAYSNLKGSYLVPNDVAEAALFLAGDESNYVSGHSLLLDGGYTITNAGFSPNAGFSPGQSE

SEQ ID NO: 1095 - DNA, 816 bp, Populus balsamifera subsp. trichocarpa
  misc_feature: Ceres ANNOT ID no.1487614
  misc_feature: Encodes the peptide sequence at SEQ ID NO 1096
atgggaagtgtttcgctagtctctgcagccctaagaaggctagaaggcaaggtggcactgatcactggaggatcaagtggcataggagagtccactgcaagactcttcgtcaaacatggagctaaggtggtaattgcagacattcaagatgaattgggccactccgtttgcaaggaattagaacctgaacctgcttcattcatccattgtgatgttactcaagaaaaagatgttgaaaacgctgttaatacagctgtttctaagtatggaaagcttgacatcatgttcaacaacgcaggtacaggaggaacgccaaaaacaaacataattgaaaatgacaaggccgaatttgagaagatcatttgtgccaatttagtaggtgcattcttaggcactaagcatgcagcccgtgtaatgatccctgctcggcgcggtagcataattacaactgcaagtgtttgtgcaataattggaggaggttcatcacatgcctacactagttcaaagcatggtgtgttaggattaatgagaaacacggctgtggaattaggacaatatggcatccgtgtaaattgtgtgtcaccgtacgcggttcctaccccattgtttaagaatttctttaagatgaacgacgatgaagttagttgcatttactctaacctcaaggaagctgtgcttgaagcagaagacattgctgaggctgctctttatttggggagtgatgaatcaaagtatgttagtggacacaatctggtggtagatggtggcttcactattgtaaatccaggtttttgcatgtttccacgatctagctga

SEQ ID NO: 1096 - protein, 271 aa, Populus balsamifera subsp. trichocarpa
  misc_feature: Ceres ANNOT ID no.1487614
  misc_feature: Bit score of 635.5 for HMM based on sequences of FIGURE 8.
  misc_feature (17)..(184): Pfam Name: adh_short Pfam Description: short chain dehydrogenase
  misc_feature: Functional Homolog Of Ceres SEEDLINE ID no. ME18396 at SEQ ID NO. 1012
MGSVSLVSAALRRLEGKVALITGGSSGIGESTARLFVKHGAKVVIADIQDELGHSVCKELEPEPASFIHCDVTQEKDVENAVNTAVSKYGKLDIMFNNAGTGGTPKTNIIENDKAEFEKIICANLVGAFLGTKHAARVMIPARRGSIITTASVCAIIGGGSSHAYTSSKHGVLGLMRNTAVELGQYGIRVNCVSPYAVPTPLFKNFFKMNDDEVSCIYSNLKEAVLEAEDIAEAALYLGSDESKYVSGHNLVVDGGFTIVNPGFCMFPRSS

SEQ ID NO: 1097 - DNA, 918 bp, Populus balsamifera subsp. trichocarpa
  misc_feature: Ceres ANNOT ID no.1541881
  misc_feature: Encodes the peptide sequence at SEQ ID NO 1098
atggctatattagggaagtatcatgtgctaggaaaacacagagagtggctaccaggggagctggtactgattcatggggagtgtttcacttgtctcagcagccctaagaaggtaacgaaagctttttgctggtgttgtaggctagaaggcaaggtggcattgatcactggagggtctagtggcataggagagtccgctgctagactgttcgccaaacatggagctaaagtggtgattgcagacgttcaagatgaactaggccactctgtttgcgaagaattgaagactgaatcagcctcattcgtccactgtgatgttactcaagaaaaagatgttgaaaatgctgttaacacagctgtttctaagcatggaaagctggacatcatgttcaataatgcaggaatagtaggcacgccaaaaccaaacatacttgacaatgacaaggctgaatttgagaaggtcattagtgttaatgtcgtgggcgcattcttaggcactaagcacgcagcccgcgtaatgatccctgttcggcgaggtagcataatctcaaccgctagcgtttgcggaacaattggaggtgttgcatcacatgcctacacaagttcaaagcatggcgtgatagggttaatgagaaacacagctgtggagttagggcagcatggcatccgtgtaaattgcgtgtcgccctacgttgttttgaccccattggtgaaggatttctttaagctggatgatgatgaagtaaatcgtctttactctaatctgaaagaagcagttctgaaagcagaagacattgcggaggctgctctttttctggggagtgatgagtccaagtatgttagtggacataatttgattgtagacgggggcttcaccattgttaatccaggtttttgtatgtttccacaatctatttga

SEQ ID NO: 1098 - protein, 305 aa, Populus balsamifera subsp. trichocarpa
  misc_feature: Ceres ANNOT ID no.1541881
  misc_feature: Bit score of 625.3 for HMM based on sequences of FIGURE 8.
  misc_feature (51)..(218): Pfam Name: adh_short Pfam Description: short chain dehydrogenase
  misc_feature: Functional Homolog Of Ceres SEEDLINE ID no. ME18396 at SEQ ID NO. 1012
MAILGKYHVLGKHREWLPGELVLIHGECFTCLSSPKKVTKAFCWCCRLEGKVALITGGSSGIGESAARLFAKHGAKVVIADVQDELGHSVCEELKTESASFVHCDVTQEKDVENAVNTAVSKHGKLDIMFNNAGIVGTPKPNILDNDKAEFEKVISVNVVGAFLGTKHAARVMIPVRRGSIISTASVCGTIGGVASHAYTSSKHGVIGLMRNTAVELGQHGIRVNCVSPYVVLTPLVKDFFKLDDDEVNRLYSNLKEAVLKAEDIAEAALFLGSDESKYVSGHNLIVDGGFTIVNPGFCMFPQSI

SEQ ID NO: 1099 - DNA, 1125 bp, Populus balsamifera subsp. trichocarpa
  misc_feature: Ceres ANNOT ID no.1488465
  misc_feature: Encodes the peptide sequence at SEQ ID NO 1100
atggctatattagggaagtatcatgtgctaggaaaacacagagagtggctaccaggggagctggtactgattcatggggagtgtttcacttgtctcagcagccctaagaaggtaacgaaagctttttgctggtgttgtaggctagaaggcaaggtggcattgatcactggagggtctagtggcataggagagtccgctgctagactgttcgccaaacatggagctaaagtggtgattgcagacgttcaagatgaactaggccactctgtttgcgaagaattgaagactgaatcagcctcattcgtccactgtgatgttactcaagaaaaagatgttgaaaatgctgttaacacagctgtttctaagcatggaaagctggacatcatgttcaataatgcaggaatagtaggcacgccaaaaccaaacatacttgacaatgacaaggctgaatttgagaaggtcattagtgttaatgtcgtgggcgcattcttaggcactaagcacgcagcccgcgtaatgatccctgttcggcgaggtagcataatctcaaccgctagcgtttgcggaacaattggaggtgttgcatcacatgcctacacaagttcaaagcatggcgtgatagggttaatgagaaacacagctgtggagttagggcagcatggcatccgtgtaaattgcgtgtcgccctacgttgttttgaccccattggtgaaggatttctttaagctggatgatgatgaagtaaatcgtctttactctaatctgaaagaagcagttctgaaagcagaagacattgcggaggctgctctttttctggggagtgatgagtccaagtatgttagtggacataatttgattgtagacgggggcttcaccattgttaatccagatattgatatacgccgtgctgagtttgatatattttcacatcagtgttctgtttttaagcacaaagcagagaaagagaagtgtcttgggacttgggagagcggacaaaatcctgtagtcttgggacttgttcaatttctaaaatctatggagtgtggaccaccaaaaggcaaaattttcaacaaaggaataagagaggacaaaaccctaaaggccaaattctcaacaaaggaataa

SEQ ID NO: 1100 - protein, 374 aa, Populus balsamifera subsp. trichocarpa
  misc_feature: Ceres ANNOT ID no.1488465
  misc_feature: Bit score of 608.6 for HMM based on sequences of FIGURE 8.
  misc_feature (51)..(218): Pfam Name: adh_short Pfam Description: short chain dehydrogenase
  misc_feature: Functional Homolog Of Ceres SEEDLINE ID no. ME18396 at SEQ ID NO. 1012
MAILGKYHVLGKHREWLPGELVLIHGECFTCLSSPKKVTKAFCWCCRLEGKVALITGGSSGIGESAARLFAKHGAKVVIADVQDELGHSVCEELKTESASFVHCDVTQEKDVENAVNTAVSKHGKLDIMFNNAGIVGTPKPNILDNDKAEFEKVISVNVVGAFLGTKHAARVMIPVRRGSIISTASVCGTIGGVASHAYTSSKHGVIGLMRNTAVELGQHGIRVNCVSPYVVLTPLVKDFFKLDDDEVNRLYSNLKEAVLKAEDIAEAALFLGSDESKYVSGHNLIVDGGFTIVNPDIDIRRAEFDIFSHQCSVFKHKAEKEKCLGTWESGQNPVVLGLVQFLKSMECGPPKGKIFNKGIREDKTLKAKFSTKE

SEQ ID NO: 1101 - DNA, 828 bp, Populus balsamifera subsp. trichocarpa
  misc_feature: Ceres ANNOT ID no.1488468
  misc_feature: Encodes the peptide sequence at SEQ ID NO 1102
atgggaagtgtctcgctactttctacagttgcaagaaggctagaaggtaaagtggcgttgatcaccggtggggctcgtggcattggagagtcaactgcaagacacttcttcaaacatggagcaaaagtagtgattgcagatactcaagatgagttggctcattctgtttgcaaagatttgaactctgaatctgcttcttttatccattgtgacgttacaaaagaaacagatgtagaaaatgcagtgaacacagccatttcaaggcatggcaagctagacgttatgttcaataatgctggcattgtaggagtggtgaaaaccaacatggttgatgtttccatgtctgaattcgaggaagtcattagggttaacctagtaggtgctttcctgggcactaaacatgcagctcgtgtgatgaagcctgctcgacaaggcagcatcataacaacctctagtgtttgtggtattctgggaggttttgcatcccatgcctacacaagttcaaagcatggcgtgttagggctaatgagaaatgcagctgttgagcttggacaatttggcattcgtgtaaattgcgtctccccgtacactgttgcaactgaaatgtcaagaaatttcttgaagatgactgatgatgaaattcgcagtggttattctaaccttaagggggcaattctgacgcctgaagatgtggctgaagcagctctctacttggcaagtgaggactccagatatgtgagcggccacaatctcgtggtagatggcggccacaccatcgtaaataatggttcttgtatgtatgataacccaagtgtgtatggtctctga

SEQ ID NO: 1102 - protein, 275 aa, Populus balsamifera subsp. trichocarpa
  misc_feature: Ceres ANNOT ID no.1488468
  misc_feature: Bit score of 585.8 for HMM based on sequences of FIGURE 8.
  misc_feature (17)..(184): Pfam Name: adh_short Pfam Description: short chain dehydrogenase
  misc_feature: Functional Homolog Of Ceres SEEDLINE ID no. ME18396 at SEQ ID NO. 1012
MGSVSLLSTVARRLEGKVALITGGARGIGESTARHFFKHGAKVVIADTQDELAHSVCKDLNSESASFIHCDVTKETDVENAVNTAISRHGKLDVMFNNAGIVGVVKTNMVDVSMSEFEEVIRVNLVGAFLGTKHAARVMKPARQGSIITTSSVCGILGGFASHAYTSSKHGVLGLMRNAAVELGQFGIRVNCVSPYTVATEMSRNFLKMTDDEIRSGYSNLKGAILTPEDVAEAALYLASEDSRYVSGHNLVVDGGHTIVNNGSCMYDNPSVYGL

SEQ ID NO: 1103 - DNA, 894 bp, Populus balsamifera subsp. trichocarpa
  misc_feature: Ceres ANNOT ID no.1541884
  misc_feature: Encodes the peptide sequence at SEQ ID NO 1104
atgggaagtgtctcgctactttctacagttgcaagaaggctagaaggtaaagtggcgttgatcaccggtggggctcgtggcattggagagtcaactgcaagacacttcttcaaacatggagcaaaagtagtgattgcagatactcaagatgagttggctcattctgtttgcaaagatttgaactctgaatctgcttcttttatccattgtgacgttacaaaagaaacagatgtagaaaatgcagtgaacacagccatttcaaggcatggcaagctagacgttatgttcaataatgctggcattgtaggagtggtgaaaaccaacatggttgatgtttccatgtctgaattcgaggaagtcattagggttaacctagtaggtgctttcctgggcactaaacatgcagctcgtgtgatgaagcctgctcgacaaggcagcatcataacaacctctagtgtttgtggtattctgggaggttttgcatcccatgcctacacaagttcaaagcatggcgtgttagggctaatgagaaatgcagctgttgagcttggacaatttggcattcgtgtaaattgcgtctccccgtacactgttgcaactgaaatgtcaagaaatttcttgaagatgactgatgatgaaattcgcagtggttattctaaccttaagggggcaattctgacgcctgaagatgtggctgaagcagctctctacttggcaagtgaggactccagatatgtgagcggccacaatctcgtggtagatggcggccacaccatcgtaaataatggttcttgtatgtatgataacccaagtgttgatcatgaattgagattcatatatatatatatatatatatatatatatatatatatatatataatttgctttttatga

SEQ ID NO: 1104 - protein, 297 aa, Populus balsamifera subsp. trichocarpa
  misc_feature: Ceres ANNOT ID no.1541884
  misc_feature: Bit score of 586.8 for HMM based on sequences of FIGURE 8.
  misc_feature (17)..(184): Pfam Name: adh_short Pfam Description: short chain dehydrogenase
  misc_feature: Functional Homolog Of Ceres SEEDLINE ID no. ME18396 at SEQ ID NO. 1012
MGSVSLLSTVARRLEGKVALITGGARGIGESTARHFFKHGAKVVIADTQDELAHSVCKDLNSESASFIHCDVTKETDVENAVNTAISRHGKLDVMFNNAGIVGVVKTNMVDVSMSEFEEVIRVNLVGAFLGTKHAARVMKPARQGSIITTSSVCGILGGFASHAYTSSKHGVLGLMRNAAVELGQFGIRVNCVSPYTVATEMSRNFLKMTDDEIRSGYSNLKGAILTPEDVAEAALYLASEDSRYVSGHNLVVDGGHTIVNNGSCMYDNPSVDHELRFIYIYIYIYIYIYIYIICFL

SEQ ID NO: 1105 - DNA, 825 bp, Populus balsamifera subsp. trichocarpa
  misc_feature: Ceres ANNOT ID no.1454972
  misc_feature: Encodes the peptide sequence at SEQ ID NO 1106
atgacaacaacaggatttatctcttcagttgctagaaggctggaaggaaaagtagccttaatcactggaggagccagcggcattggagaatgcacagctaaagtgtttgcccaccacggtgccaaagtggtcgttgctgacatccaagatgaatcgggtcgttcacttgctaaagccctaggtccatcaaactctacctatgtgcactgtgacgtaactgatgaggcccaagtaaaaaatgcagtgaacgccgctgtcacaacttatggcaagctagacataatgttcaacaatgccggcattgctgatgagagcaaagcacgcataattgacaatgaaaaggttgattttgaacgtgttctgcagactaatgtgacgggagtttttcttggcatcaaacatgcagcccgtgtcatgatcccgggacgcaatggtaccataatttcaactgccagtgttagctcaaaagttggtgctgctgcctcacatgcatattgttgctccaagcatgctgttctaggactcaccaaaaatgctgctgttgagcttgggcaatttggcatcagagtgaactgtttatcaccttatgcgcttgcaacccctttagcaaaacaagttattggtcttgatgatgaacaacttgagaatttgatgcacgcttttggtaccctaaagggtgtgacccttcaggcagaagatgtagccaacgcagcactttatctggcaagtgatgaagctagatatgtcagtgggcacaatttattcatagatgggggttttaccattcagaacccatcattccgcatgttccagtatcctgaatag

SEQ ID NO: 1106 - protein, 274 aa, Populus balsamifera subsp. trichocarpa
  misc_feature: Ceres ANNOT ID no.1454972
  misc_feature: Bit score of 639.7 for HMM based on sequences of FIGURE 8.
  misc_feature (17)..(184): Pfam Name: adh_short Pfam Description: short chain dehydrogenase
  misc_feature: Functional Homolog Of Ceres SEEDLINE ID no. ME18396 at SEQ ID NO. 1012
MTTTGFISSVARRLEGKVALITGGASGIGECTAKVFAHHGAKVVVADIQDESGRSLAKALGPSNSTYVHCDVTDEAQVKNAVNAAVTTYGKLDIMFNNAGIADESKARIIDNEKVDFERVLQTNVTGVFLGIKHAARVMIPGRNGTIISTASVSSKVGAAASHAYCCSKHAVLGLTKNAAVELGQFGIRVNCLSPYALATPLAKQVIGLDDEQLENLMHAFGTLKGVTLQAEDVANAALYLASDEARYVSGHNLFIDGGFTIQNPSFRMFQYPE

SEQ ID NO: 1107 - DNA, 831 bp, Populus balsamifera subsp. trichocarpa
  misc_feature: Ceres ANNOT ID no.1475186
  misc_feature: Encodes the peptide sequence at SEQ ID NO 1108
atgtcaaccactgcgtttatctccaccatagccagaaggctacaaggaaaggtagccttaatcaccggcggtgctagtggtattggtgaatgcaccgcaaaagtcttctctcaccatggagctaaagtagtaattgctgatatccaagacgaattaggccattcagttgtcgaggccctaggcccttcaaactccacctacgtgcgttgcgatgtcaccgaagaggcccagataaaaaatgctgtggacaaagctatctcaacctatggcaagctagatataatgctcaacaatgctggcattgctgatgacagtaaagcacgcataatcgacaacgaaatggctgattttgaacgtgttcttaagattaacgtgaccggagttttcctcggcatcaagcacgccgcccgcgtcatgatcccagcacgcagtggcaccataatttcaactgctagtgtaagctcactacttggtgcggcagcttcacatgcatactgttgctcaaaacatgctgtgttaggactgacaagaaatgctgcagctgagcttggacagtttggcattagggtgaattgcttatctccttacgcactcgcaactcctttagcaaggaaatttattggggttgatgatgatgaggcgcttgaaattgcgatgaattcatttgctaatctaaagggagtgacccttaagacggaagatgttgccaatgcagctctttatctagccagtgatgaggctaggtatattagtgggcataatttatttatagatggagggttcagcgttcaaaacccgacattccagatgtttcagtatccagattcttga

SEQ ID NO: 1108 - protein, 276 aa, Populus balsamifera subsp. trichocarpa
  misc_feature: Ceres ANNOT ID no.1475186
  misc_feature: Bit score of 673.3 for HMM based on sequences of FIGURE 8.
  misc_feature (17)..(184): Pfam Name: adh_short Pfam Description: short chain dehydrogenase
  misc_feature: Functional Homolog Of Ceres SEEDLINE ID no. ME18396 at SEQ ID NO. 1012
MSTTAFISTIARRLQGKVALITGGASGIGECTAKVFSHHGAKVVIADIQDELGHSVVEALGPSNSTYVRCDVTEEAQIKNAVDKAISTYGKLDIMLNNAGIADDSKARIIDNEMADFERVLKINVTGVFLGIKHAARVMIPARSGTIISTASVSSLLGAAASHAYCCSKHAVLGLTRNAAAELGQFGIRVNCLSPYALATPLARKFIGVDDDEALEIAMNSFANLKGVTLKTEDVANAALYLASDEARYISGHNLFIDGGFSVQNPTFQMFQYPDS

SEQ ID NO: 1109 - DNA, 1225 bp, Gossypium hirsutum
  misc_feature: Ceres CLONE ID no.1834483
  misc_feature: Encodes the peptide sequence at SEQ ID NO 1110
aaaaaaccgcttttgaagcagaaaagtcattataggaaagcatggcagctgcttcatctttcatctcactactcacaaagaggctggaagtgaaggtagcactaattacaggaggagctagtggtattgggaaatgcactgctaaagtgtttgcacagcatggagccaaagttgtaattgctgatatccaagatgatttaggtcatcgggtttgtgaggacataggcccttcaaactgttcctacgtgcattgcaacgtcactgatgaagaccaaataaaaaatgctgttgacaaagccgtcgccactcacggaaagttggacatcatgttcaacaacgccggcatcgttgatcccaacaagagtcgcataatggacaacgacaaatcagatttcgagcgtgttcttagtgttaacgtaactggcgttttcctggggattaagcacgcagctagggtgatggttccttctcgaagtggtagcataatttcgacatccagcgtaagctccctgatcggtgctaccgccacacatgcttattgtgcttcaaagcatgcagtgctaggactaactaggaatgctgcagtggagctggggcaatttgggatccgagtgaactgcttgtctccctacgctctggcaacacctttagcgacgggattcctgggaggtaatgatgaggagctggagaaagcgatgagtaagtcagctaacctaaagggtgtgtatcttaaggccgaagatatagcaaatgcagcactctacccagcaagtgaggagggaagatatgtcagtgggcataatctgttcatagatgggggctttactgttgtcaatccgtcgctccaaatgttccaataccctgacggctcttgagaacaatattctgctcagcaaatgcttgtccatcttttatagatataaatgacgatcatccatgcattaaaaataatggataaattcctaaaaaataatgattgaataagaacttaatttagagtaattttgggctcttgatacaagtttaatcatagtttataagcatatcttgctaaaagtagtttctctactatactctaatttgtagtttggtccctctattggaaaagtaagcaagcatattgatgtatgtcagagggacgatgcatctgttatatttgaatgtttcttggaaaagtttgaagcaaaattattattattattattaaaaaaaaaaaaaaaaaaaa

SEQ ID NO: 1110 - protein, 277 aa, Gossypium hirsutum
  misc_feature: Ceres CLONE ID no.1834483
  misc_feature: Bit score of 712.1 for HMM based on sequences of FIGURE 8.
  misc_feature (18)..(185): Pfam Name: adh_short Pfam Description: short chain dehydrogenase
  misc_feature: Functional Homolog Of Ceres SEEDLINE ID no. ME18396 at SEQ ID NO. 1012
MAAASSFISLLTKRLEVKVALITGGASGIGKCTAKVFAQHGAKVVIADIQDDLGHRVCEDIGPSNCSYVHCNVTDEDQIKNAVDKAVATHGKLDIMFNNAGIVDPNKSRIMDNDKSDFERVLSVNVTGVFLGIKHAARVMVPSRSGSIISTSSVSSLIGATATHAYCASKHAVLGLTRNAAVELGQFGIRVNCLSPYALATPLATGFLGGNDEELEKAMSKSANLKGVYLKAEDIANAALYPASEEGRYVSGHNLFIDGGFTVVNPSLQMFQYPDGS

SEQ ID NO: 1111 - DNA, 901 bp, Triticum aestivum
  misc_feature: Ceres CLONE ID no.686198
  misc_feature: Encodes the peptide sequence at SEQ ID NO 1112
agggtagtataccagtacaagttaatcaaggttagctcccatggcaagcagctccgatgtcgttcctgccgctgcaaggaagctggacggcaaggtggcgctgatcaccggcggcgcgagcggcatcggcgagggcacggcgcggctgttcgtgcagcacggggccagcgtcgtcctcgccgacatccaggacgacctcggcgcgcgcctctgcgcggagctcggcccggcggcctccagctacgtgcggtgcgacgtcaccaaagaggaggacgtcgcggcggccgtcgaccacaccatcgccaggttcgggaagctggacatcatgttcaacaacgccggcatcggcggtgcggcatgccacagcatccgggacagcaccaaggaggacttcgagcgcgtgctggccgtcaacctcgtggggcccttcctgggtaccaagcacgcggcgcgggtcatggtgcccgcgcggcaaggctgcatcatcgggacgtcgagcctggcgtcggcggtgggcggcgtggcgtcgcacgcgtacacgtgcgccaagcgcgccctggtcgggctgacggagaacgcggcgacggagcttggccagcatggaatccgcgtcaactgcatctccccggcggcggctgccacgccgctggccacgggctacgtggggcttgacggcgaggcgttcgagatggccatggagtcctttgctaacctcaagggcgtgggactgcgggtcaaggacatcgccgccgccgtgctctttctcgccagcgatgacgcgcgctacgtgagcggccacaacctgctcatcgacggcggcatctccgtctcaaaccttaccttcggcatcttcaaggagtaatggaaaccgatcgattctaaactaaaaaaaaaaaaaaaa

SEQ ID NO: 1112 - protein, 273 aa, Triticum aestivum
  misc_feature: Ceres CLONE ID no.686198
  misc_feature: Bit score of 551.2 for HMM based on sequences of FIGURE 8.
  misc_feature (18)..(185): Pfam Name: adh_short Pfam Description: short chain dehydrogenase
  misc_feature: Functional Homolog Of Ceres SEEDLINE ID no. ME18396 at SEQ ID NO. 1012
MASSSDVVPAAARKLDGKVALITGGASGIGEGTARLFVQHGASVVLADIQDDLGARLCAELGPAASSYVRCDVTKEEDVAAAVDHTIARFGKLDIMFNNAGIGGAACHSIRDSTKEDFERVLAVNLVGPFLGTKHAARVMVPARQGCIIGTSSLASAVGGVASHAYTCAKRALVGLTENAATELGQHGIRVNCISPAAAATPLATGYVGLDGEAFEMAMESFANLKGVGLRVKDIAAAVLFLASDDARYVSGHNLLIDGGISVSNLTFGIFKE

SEQ ID NO: 1113 - protein, 270 aa, Lactuca sativa
  misc_feature: Public GI ID no.84579418
  misc_feature: Bit score of 681.6 for HMM based on sequences of FIGURE 8.
  misc_feature (11)..(178): Pfam Name: adh_short Pfam Description: short chain dehydrogenase
  misc_feature: Functional Homolog Of Ceres SEEDLINE ID no. ME18396 at SEQ ID NO. 1012
MTSITKRLEGKVALITGAASGIGECTAKLFAEHGAKVVIADIQDQLGQAVCEAIGTSNSIYVHCDVTNEEDIKNAVDTAVTTYGKLDIMFNNAGVVDPIKARIIDNEKTNFERVLNVNVTGVFLCMKHAARVMVPQRSGTIISSSSLSSHLGGIASHAYCCSKHAIAGLTKNLAVELGQFGIRVNCLSAYGIATPLTKKITGLEKEAFESAMNLTANLKGVTLKTDDAAYAALFLVSDEAKYISGQNLLIDGGLSYANTSFNFFKYGEEL

SEQ ID NO: 1114 - protein, 271 aa, Lactuca sativa
  misc_feature: Public GI ID no.84579420
  misc_feature: Bit score of 637.6 for HMM based on sequences of FIGURE 8.
  misc_feature (11)..(178): Pfam Name: adh_short Pfam Description: short chain dehydrogenase
  misc_feature: Functional Homolog Of Ceres SEEDLINE ID no. ME18396 at SEQ ID NO. 1012
MATTTRRLEGKVALITGAASGIGECAAKLFAEHGAKIVIADIQDQLGQAVCEAIGSSNSIYIHCDVTNEEDVRKAVDIAIATYGKLDIMFCNAGIIDPNKDHIIDNEKSDFERVLSVNVTGVFLSMKHAARVMVPTRAGSIISTASVVSNIGGLCPHAYTCSKHAVAGLTKNLAVELGQFGIRVNCLSPYAIDTPQATGFTGLKGEDFKNKVNSVANLKGVTLTTDDVAKAAVFLASDEAKYISGHNLFIDGGFSIVNPSFNMFQYPENPL

SEQ ID NO: 1115 - DNA, 1067 bp, Glycine max
  misc_feature: Ceres CLONE ID no.605144
  misc_feature: Encodes the peptide sequence at SEQ ID NO 1116
aatttcatatcgtaacaggttgttccttctatccctttcttttggtcttaggtcatatatcaatggcaacttcaacctctgcactcaataaaaggctggaaggaaaagttgcactgatcacaggaggagctagtggcatcggcaaacgcactgcagaagtgttcgctcagcaaggagccaaagtagtgatcgctgacatccaagacgaactgggacattccgttgctcagtccatagggccatcaacatgttgttatgtccattgcgatgtcaccgatgagaaccaaataaaaaatgccgtccaaaaagccgtagatgcttatgggaagctagacatcatgttcaacaacgccggcattgttgatcccaacaagaaccgaatcattgacaacgataaggcagatttcgaacgtgtcctaagcgtcaatgtcacgggtgttttccttgggatgaagcatgcggcgcaggcgatgatcccagcacgcagtggtagcatcatctctacggccagcataagctcctacgttggtggtgcagcctcgcatgcttactgttgtgctaagcatgctgtggttggtctaactaaaaatgcagcagttgagcttggacagttcggaataagggtgaattgtttgtcaccttacgctcttgctacacctttggccaccaagtttgttggagctaatgatgaggagcttgagactatcatgaactcactggctaatctcaagggtgtcactcttaaagctgaggatgtggctaatgccgcactttattttgctagtgatgattccaggtacgtcagtgggcaaaatttgctcatagatggaggcttcagcattgttaatccttcctttcacatgtttcagtacccggactcggagtcttgatttttgtctactatgaagaagcaagagtaattaataagggctcatatagattgagctatagtgcttgtgggattgggctttgattgtaaaacatacgggtgtttaaaaatgttgaactgaaccaaattgtgtgaaatcatcctatttaatttgtttcaattcaagtttactataacg

SEQ ID NO: 1116 - protein, 275 aa, Glycine max
  misc_feature: Ceres CLONE ID no.605144
  misc_feature: Bit score of 642.7 for HMM based on sequences of FIGURE 8.
  misc_feature (15)..(182): Pfam Name: adh_short Pfam Description: short chain dehydrogenase
  misc_feature: Functional Homolog Of Ceres SEEDLINE ID no. ME18396 at SEQ ID NO. 1012
MATSTSALNKRLEGKVALITGGASGIGKRTAEVFAQQGAKVVIADIQDELGHSVAQSIGPSTCCYVHCDVTDENQIKNAVQKAVDAYGKLDIMFNNAGIVDPNKNRIIDNDKADFERVLSVNVTGVFLGMKHAAQAMIPARSGSIISTASISSYVGGAASHAYCCAKHAVVGLTKNAAVELGQFGIRVNCLSPYALATPLATKFVGANDEELETIMNSLANLKGVTLKAEDVANAALYFASDDSRYVSGQNLLIDGGFSIVNPSFHMFQYPDSES

SEQ ID NO: 1117 - protein, 271 aa, Cucumis sativus
  misc_feature: Public GI ID no.15077030
  misc_feature: Bit score of 655.9 for HMM based on sequences of FIGURE 8.
  misc_feature (16)..(184): Pfam Name: adh_short Pfam Description: short chain dehydrogenase
  misc_feature: Functional Homolog Of Ceres SEEDLINE ID no. ME18396 at SEQ ID NO. 1012
MSIQLLPAIARRLEGKVAVITGGARGIGEQTAKLFFKHGAKVVIADIQDHLGQTLCKDLGQSSSVFVHCDVTKEKDVETAVDTAVSKYGKLDIMLNNAGVFEESPNFDFLKDDPLTFQRVVNVNLVGAFLGTKHAARVMKPAGRGSIVTTASICSVIGGIGTHAYTSSKHGVLGLMRNAAVDLGRYGIRVNCVSPNVVPTEMGRKLFKVKDGGEFPSFYWSLKNGDILREEDVGEAVVYLGSDESKCVSGLNLIVDGGFTVVNQALCSFRS

SEQ ID NO: 1118 - protein, 277 aa, Forsythia x intermedia
  misc_feature: Public GI ID no.13752458
  misc_feature: Bit score of 712.5 for HMM based on sequences of FIGURE 8.
  misc_feature (18)..(185): Pfam Name: adh_short Pfam Description: short chain dehydrogenase
  misc_feature: Functional Homolog Of Ceres SEEDLINE ID no. ME18396 at SEQ ID NO. 1012
MAATSQVLTAIARRLEGKVALITGGASGIGETTAKLFSQHGAKVAIADVQDELGHSVVEAIGTSNSTYIHCDVTNEDGVKNAVDNTVSTYGKLDIMFSNAGISDPNRPRIIDNEKADFERVFSVNVTGVFLCMKHAARVMIPARSGNIISTASLSSTMGGGSSHAYCGSKHAVLGLTRNLAVELGQFGIRVNCLSPFGLPTALGKKFSGIKNEEEFENVINFAGNLKGPKFNVEDVANAALYLASDEAKYVSGHNLFIDGGFSVCNSVIKVFQYPDS

SEQ ID NO: 1119 - protein, 271 aa, Cucumis sativus
  misc_feature: Public GI ID no.15077028
  misc_feature: Bit score of 645.4 for HMM based on sequences of FIGURE 8.
  misc_feature (16)..(184): Pfam Name: adh_short Pfam Description: short chain dehydrogenase
  misc_feature: Functional Homolog Of Ceres SEEDLINE ID no. ME18396 at SEQ ID NO. 1012
MSIQLLPAIARRLEGKVAVITGGARGIGEQTAKLFFKHGAKVVIADIQDHLGQTLCKDLGQSSSVFVHCDVTKEKDVETAVDTAVSKYGKLDIMLNNAGVFEESPNFDILKDDPLTFQRVVNVNLVGASLGTRHAARVMKPAGRGSIVTTASICSVIGGIGTHAYTSSKHGVLGLMRNAAVDLGRYGIRVNCVSPNVVPTEMGRKLFKVKDGGEFPSFYWSLKNGDILREEDVGEAVVYLGSDESKCVSGLNLIVDGGFTVVNQALCSFRS

SEQ ID NO: 1120 - DNA, 996 bp, Populus balsamifera subsp. trichocarpa
  misc_feature: Ceres ANNOT ID no.1454963
  misc_feature: Encodes the peptide sequence at SEQ ID NO 1121
atgaactcctctagttcactagcttcttttgcaaaaaggttagctggtaaagtggcaataatcactggaggtgctagcgggattggtgagagcacctctagactatttgttgaacatggagcgaatgtcattatagctgatgtccaggatcaagttggtcaatccctttgtaaggaacttggcacggagaacaatgtttactatgtacactgtgatgtcactagtgataccgatgtcaaaaatgttgtcgattttgccatatccaagtatgggaagctagacatcatgtacaacaacgctggcattactggcaatatagatccaacaatattaggcaccgagaatgaaaattttaaaagggtttttgaagttaatgtgtatggtggtttcttgggtgcaaagcatgctgctagagttatgattcctgtgaaaaaaggcgttattcttttcacatctagtgtggcttcaatggcttgtggtgagtcgcctcatgcttatacaatgtcgaagcatgcggtggtggggctaatgaagaatttgtgcgtggaactagggcaatatggaataagggttaactgcatttctccgtgtgctcttgctactccactgctaagaaatgcaatgggagcggataaaagttttgtggagcatgtagtttgtgaatctgccaatctgaaaggagtggtgccgtcacccaaagatgtggcggaggctgccttgtatttaggtagcgatgagtccaagtatgtgagtggactaaatctcatggttgatgggggatacagcaccactaaccagtccttcaatatgttagggcaatatacaatagtaatgttagaggttaccacacaagagtatgattacaatatttcccatataggtatattctataatatgccccttcaagttgagggtgggggatcaacccgaagcttgaaaataaaagcagtaaatgaagcagtaggaagtggcttagtgaagacatctgcaagttga

SEQ ID NO: 1121 - protein, 331 aa, Populus balsamifera subsp. trichocarpa
  misc_feature: Ceres ANNOT ID no.1454963
  misc_feature: Bit score of 536.4 for HMM based on sequences of FIGURE 8.
  misc_feature (17)..(185): Pfam Name: adh_short Pfam Description: short chain dehydrogenase
  misc_feature: Functional Homolog Of Ceres SEEDLINE ID no. ME18396 at SEQ ID NO. 1012
MNSSSSLASFAKRLAGKVAIITGGASGIGESTSRLFVEHGANVIIADVQDQVGQSLCKELGTENNVYYVHCDVTSDTDVKNVVDFAISKYGKLDIMYNNAGITGNIDPTILGTENENFKRVFEVNVYGGFLGAKHAARVMIPVKKGVILFTSSVASMACGESPHAYTMSKHAVVGLMKNLCVELGQYGIRVNCISPCALATPLLRNAMGADKSFVEHVVCESANLKGVVPSPKDVAEAALYLGSDESKYVSGLNLMVDGGYSTTNQSFNMLGQYTIVMLEVTTQEYDYNISHIGIFYNMPLQVEGGGSTRSLKIKAVNEAVGSGLVKTSAS

SEQ ID NO: 1122 - DNA, 831 bp, Sorghum bicolor
  misc_feature: Ceres ANNOT ID no.6030208
  misc_feature: Encodes the peptide sequence at SEQ ID NO 1123
atggcagccagcagctccgatcaagttcctccagccgcaatgaagctggagggcaaggtggcgctgatcaccggcggcgcgagcggcatcggggagtgcacggcgcggctcttcgtgaagcacggcgcgcgcgtcgtggtggcggacatccaggacgaagccggcgccgctctctgcgccgagctgggcgccgacgccgtcgccagctacgtgcactgcgacgtcaccgtcgaggccgacgtcgcggcggccgtggaccacgccgtggcccggttcggcgcgctggacatcatgttcaacaacgcgggcatcggcggcgcggcttgccacagcatccgggagagcaccaaggaggacttcgagcgcgtgctctccgtcaacctcgtgggaccgttcctgggcaccaagcacgcggcgcgggtcatggtccccgcgggccgcggcggctgcatcatcggcacgtccagcctcgcctccgcggtggccggcgccgcgtcgcacgcctacacgtgcgccaagcgcggcctcgtggcgctcacggagaacgccgccgcggagctgggtcgccacgggatccgggtcaactgcgtctcgcccgccgcggctgccacgccgctcgccacggcgtacgtgggactggagggggaggcgttcgagcaggccatggaggccgtcgctaacctcaagggcgttcgcctgcgggtggcggacatcgccgccgccgtgctctacctcgccagcgacgacgcgcggtacatcagcgggcacaacctgctcctcgacgggggcttctccatcgtcaacccgtcctttgggatcttcaaagattga

SEQ ID NO: 1123 - protein, 276 aa, Sorghum bicolor
  misc_feature: Ceres ANNOT ID no.6030208
  misc_feature: Bit score of 544.7 for HMM based on sequences of FIGURE 8.
  misc_feature (19)..(188): Pfam Name: adh_short Pfam Description: short chain dehydrogenase
  misc_feature: Functional Homolog Of Ceres SEEDLINE ID no. ME18396 at SEQ ID NO. 1012
MAASSSDQVPPAAMKLEGKVALITGGASGIGECTARLFVKHGARVVVADIQDEAGAALCAELGADAVASYVHCDVTVEADVAAAVDHAVARFGALDIMFNNAGIGGAACHSIRESTKEDFERVLSVNLVGPFLGTKHAARVMVPAGRGGCIIGTSSLASAVAGAASHAYTCAKRGLVALTENAAAELGRHGIRVNCVSPAAAATPLATAYVGLEGEAFEQAMEAVANLKGVRLRVADIAAAVLYLASDDARYISGHNLLLDGGFSIVNPSFGIFKD

SEQ ID NO: 1124 - DNA, 831 bp, Sorghum bicolor
  misc_feature: Ceres ANNOT ID no.6076767
  misc_feature: Encodes the peptide sequence at SEQ ID NO 1125
atggcaagcagtaccgtcgccctccccaccactccaccaagaaagttgcagggaaaggtggccatgatcactggcggggcgagcgggatcggcgagcgcacggtgcggctgttcgtggagcacggcgcccgcgtcgtggtggccgacatccaggacgaggccggcgcgcgcgtctgcgccgacgttggcgcgggcgccgccagctacttccactgcgacgtgaccagcgaggacgacgtcgctgccgcggtggaccacgccgtggcgacgttcggagcgctggatatcatgttcaacaatgctggcgtcagcgggccggcgtgctacagcgtccgggacagcggcaaggctgacttcgagcgcgtgctggccgtgaacctggtgggcccgttcctcggcaccaagcacgcggcgcgggtgatggtacccgcgcgccgcggcggctgcatcatagggacgtccagcgtggcggcggccgtgaccggcgcgtcctcgtacgcgtacgcgtgcgcgaagcgcgcgctcgtggcgctgacggagaacgccgcggcggagctcggccggcacggcatccgcgtgaactgcgtctcccccgcgggggtcgccacgccgctgaccatgaggtacatgggcctcgaagcggaggcgttcgagcaggcaatggaggccatatcaaacctcaagggcgtgggcgccctgcgagcggacgacgtcgccgccgccgtgctcttcctcgccagcgatgacgcgcggtacatcagcggccacaacctgttcgtcgacggtggcatctctatcgcgaacccgtcctttggaacgtccaaagactga

SEQ ID NO: 1125 - protein, 276 aa, Sorghum bicolor
  misc_feature: Ceres ANNOT ID no.6076767
  misc_feature: Bit score of 502.4 for HMM based on sequences of FIGURE 8.
  misc_feature (19)..(187): Pfam Name: adh_short Pfam Description: short chain dehydrogenase
  misc_feature: Functional Homolog Of Ceres SEEDLINE ID no. ME18396 at SEQ ID NO. 1012
MASSTVALPTTPPRKLQGKVAMITGGASGIGERTVRLFVEHGARVVVADIQDEAGARVCADVGAGAASYFHCDVTSEDDVAAAVDHAVATFGALDIMFNNAGVSGPACYSVRDSGKADFERVLAVNLVGPFLGTKHAARVMVPARRGGCIIGTSSVAAAVTGASSYAYACAKRALVALTENAAAELGRHGIRVNCVSPAGVATPLTMRYMGLEAEAFEQAMEAISNLKGVGALRADDVAAAVLFLASDDARYISGHNLFVDGGISIANPSFGTSKD

SEQ ID NO: 1126 - DNA, 2027 bp, Arabidopsis thaliana
  misc_feature: Ceres SEEDLINE ID no.ME20095
  misc_feature: Genomic Sequence
  misc_feature: Expected Sequence
  misc_feature: Encodes the peptide sequence at SEQ ID NO. 1129
atggacatgaaatctggtcactcgtctcctgtaatgactgattctccaccaataagcaactcaagattaaccattcgtcagaatagacttccttactcatcagcagcagccacggctatctcacagaacaacaatctcttactaaccgttccaagaaagaaaactgggatccttgatgatgttaagtctaatggttggcttgatgcgatgaaatcttcttctcctcctcctacaatacttaacaaagataacttaagcaatgatgctacggatatgacttatcgcgaatggatggtcagtcccttactgtcctttttttcatctgaaaatatgtgccgttgttttgatgttgatagtcttctttttgttttgttttataatcctgttttagcagctcaagtatccatcagctcttacctcttttgagaaaatcatgagttttgcaaaaggcaaaagaatagcattgtttcttgattatgacgggacactttcgcctattgttgaggaacctgattgtgcatacatgtcaagtgctgtaagtttttaactttcctctattaaattcaattgctaaaacagatcaaatttgtgattcatcctcataatgaattatatggttcacgcctttttacatgtttagatgcgtagtgcagtgcaaaatgttgccaagtatttccctaccgcgatcattagtggaagaagccgggataaggtaatctttctacatgttttattttcttcatcaagaacattttcttgtgtgatctaatgtaataatagtacattttgcttcatctaggtgtatgagtttgttaatttgagtgaactttattacgccggaagccatggaatggacatcatgagtcccgcaggagaatctttaaaccatgaacatagccgtactgtatcagtttacgaacaggttcattttcttgctttttgtttgttttctacaatatctgtttgctacatcagattcttaaaatgtgatgtttgcaaatttcaggggaaagatgtaaatctattccagcctgctagcgagtttctcccgatgatcgataaggtattttgaaacacatcttctgctatatataacaacatcatgtatgattgttgaactcttgatatgatcttctcaggtgctttgttctcttatagagagtacaaaagatatcaaaggggtaaaagtagaagacaacaagttctgcatctctgtgcattaccgcaatgtagaagaaaaggtttggtttctcaattcagtaacatttttggttcctttataaaccaatacactttcttgaaaaagctcttctttgttacagaactggacattggttgcacagtgtgtagatgatgtcatcagaacatatccaaaactacggctaacacatggccggaaggtaaaaacgtctgaaatctttcttacgtatttcaacaaaaagaagttcaaagttttgattttgttctcttggtttgtatgttttgcttaaaaggttttagagatccgtcctgtgattgactgggacaaagggaaagctgtgacatttctacttgaatcactcggtagttaacaaaatccttctcatctatctgcttctgttctgaatcttggtttggtttggccattgactttaatacatttctcaggcctaaacaactgtgaggatgttcttccaatctatgttggggatgatcgaacagacgaagatgcatttaaggtttgttcttataaacacattgagctaaaacatttcattaagaaatagttttgacttaaagtgcaagtaatgtcaggtactacgagatggaccaaaccacggttatggtatattagtctctgctgtgcctaaagacagcaatgccttttactcgcttcgtgacccgtctgaggtaaattaagaaatcattcaactgaaaatacttgagctacgattttagatcatacgagtttgatatttttgttatgtatatatcaggtgatggagtttctgaagtcattggtgacatggaagagatcaatgggttaa

SEQ ID NO: 1127 - DNA, 2027 bp, Arabidopsis thaliana
  misc_feature: Ceres SEEDLINE ID no.ME20095
  misc_feature: Inplanta Sequence
  misc_feature: Encodes the peptide sequence at SEQ ID NO. 1129
atggacatgaaatctggtcactcgtctcctgtaatgactgattctccaccaataagcaactcaagattaaccattcgtcagaatagacttccttactcatcagcagcagccacggctatctcacagaacaacaatctcttactaaccgttccaagaaagaaaactgggatccttgatgatgttaagtctaatggttggcttgatgcgatgaaatcttcttctcctcctcctacaatacttaacaaagataacttaagcaatgatgctacggatatgacttatcgcgaatggatggtcagtcccttactgtcctttttttcatctgaaaatatgtgccgttgttttgatgttgatagtcttctttttgttttgttttataatcctgttttagcagctcaagtatccatcagctcttacctcttttgagaaaatcatgagttttgcaaaaggcaaaagaatagcattgtttcttgattatgacgggacactttcgcctattgttgaggaacctgattgtgcatacatgtcaagtgctgtaagtttttaactttcctctattaaattcaattgctaaaacagatcaaatttgtgattcatcctcataatgaattatatggttcacgcctttttacatgtttagatgcgtagtgcagtgcaaaatgttgccaagtatttccctaccgcgatcattagtggaagaagccgggataaggtaatctttctacatgttttattttcttcatcaagaacattttcttgtgtgatctaatgtaataatagtacattttgcttcatctaggtgtatgagtttgttaatttgagtgaactttattacgccggaagccatggaatggacatcatgagtcccgcaggagaatctttaaaccatgaacatagccgtactgtatcagtttacgaacaggttcattttcttgctttttgtttgttttctacaatatctgtttgctacatcagattcttaaaatgtgatgtttgcaaatttcaggggaaagatgtaaatctattccagcctgctagcgagtttctcccgatgatcgataaggtattttgaaacacatcttctgctatatataacaacatcatgtatgattgttgaactcttgatatgatcttctcaggtgctttgttctcttatagagagtacaaaagatatcaaaggggtaaaagtagaagacaacaagttctgcatctctgtgcattaccgcaatgtagaagaaaaggtttggtttctcaattcagtaacatttttggttcctttataaaccaatacactttcttgaaaaagctcttctttgttacagaactggacattggttgcacagtgtgtagatgatgtcatcagaacatatccaaaactacggctaacacatggccggaaggtaaaaacgtctgaaatctttcttacgtatttcaacaaaaagaagttcaaagttttgattttgttctcttggtttgtatgttttgcttaaaaggttttagagatccgtcctgtgattgactgggacaaagggaaagctgtgacatttctacttgaatcactcggtagttaacaaaatccttctcatctatctgcttctgttctgaatcttggtttggtttggccattgactttaatacatttctcaggcctaaacaactgtgaggatgttcttccaatctatgttggggatgatcgaacagacgaagatgcatttaaggtttgttcttataaacacattgagctaaaacatttcattaagaaatagttttgacttaaagtgcaagtaatgtcaggtactacgagatggaccaaaccacggttatggtatattagtctctgctgtgcctaaagacagcaatgccttttactcgcttcgtgacccgtctgaggtaaattaagaaatcatgcaactgaaaatacttgagctacgattttagatcatacgagtttgatatttttgttatgtatatatcaggtgatggagtttctgaagtcattggtgacatggaagagatcaatgggttaa

SEQ ID NO: 1128 - DNA, 1158 bp, Arabidopsis thaliana
  misc_feature: Ceres SEEDLINE ID no.ME20095
  misc_feature: Inplanta Sequence shown without introns
  misc_feature: Encodes the peptide sequence at SEQ ID NO. 1129
atggacatgaaatctggtcactcgtctcctgtaatgactgattctccaccaataagcaactcaagattaaccattcgtcagaatagacttccttactcatcagcagcagccacggctatctcacagaacaacaatctcttactaaccgttccaagaaagaaaactgggatccttgatgatgttaagtctaatggttggcttgatgcgatgaaatcttcttctcctcctcctacaatacttaacaaagataacttaagcaatgatgctacggatatgacttatcgcgaatggatgcagctcaagtatccatcagctcttacctcttttgagaaaatcatgagttttgcaaaaggcaaaagaatagcattgtttcttgattatgacgggacactttcgcctattgttgaggaacctgattgtgcatacatgtcaagtgctatgcgtagtgcagtgcaaaatgttgccaagtatttccctaccgcgatcattagtggaagaagccgggataaggtgtatgagtttgttaatttgagtgaactttattacgccggaagccatggaatggacatcatgagtcccgcaggagaatctttaaaccatgaacatagccgtactgtatcagtttacgaacaggggaaagatgtaaatctattccagcctgctagcgagtttctcccgatgatcgataaggtgctttgttctcttatagagagtacaaaagatatcaaaggggtaaaagtagaagacaacaagttctgcatctctgtgcattaccgcaatgtagaagaaaagaactggacattggttgcacagtgtgtagatgatgtcatcagaacatatccaaaactacggctaacacatggccggaaggttttagagatccgtcctgtgattgactgggacaaagggaaagctgtgacatttctacttgaatcactcggcctaaacaactgtgaggatgttcttccaatctatgttggggatgatcgaacagacgaagatgcatttaaggtactacgagatggaccaaaccacggttatggtatattagtctctgctgtgcctaaagacagcaatgccttttactcgcttcgtgacccgtctgaggtgatggagtttctgaagtcattggtgacatggaagagatcaatgggttaa

SEQ ID NO: 1129 - protein, 385 aa, Arabidopsis thaliana
  misc_feature: Ceres SEEDLINE ID no.ME20095
  misc_feature: Bit score of 944.7 for HMM based on sequences of FIGURE 9.
  misc_feature (124)..(368): Pfam Name: Trehalose_PPase Pfam Description: Trehalose-phosphatase
MDMKSGHSSPVMTDSPPISNSRLTIRQNRLPYSSAAATAISQNNNLLLTVPRKKTGILDDVKSNGWLDAMKSSSPPPTILNKDNLSNDATDMTYREWMQLKYPSALTSFEKIMSFAKGKRIALFLDYDGTLSPIVEEPDCAYMSSAMRSAVQNVAKYFPTAIISGRSRDKVYEFVNLSELYYAGSHGMDIMSPAGESLNHEHSRTVSVYEQGKDVNLFQPASEFLPMIDKVLCSLIESTKDIKGVKVEDNKFCISVHYRNVEEKNWTLVAQCVDDVIRTYPKLRLTHGRKVLEIRPVIDWDKGKAVTFLLESLGLNNCEDVLPIYVGDDRTDEDAFKVLRDGPNHGYGILVSAVPKDSNAFYSLRDPSEVMEFLKSLVTWKRSMG

SEQ ID NO: 1130 - protein, 385 aa, Vitis vinifera
  misc_feature: Public GI ID no.147771549
  misc_feature: Bit score of 958.4 for HMM based on sequences of FIGURE 9.
  misc_feature (123)..(367): Pfam Name: Trehalose_PPase Pfam Description: Trehalose-phosphatase
  misc_feature: Functional Homolog Of Ceres SEEDLINE ID no. ME20095 at SEQ ID NO. 1129
MDLKSNHSSPVLTDPPPVNKSRFGIRSNLLPYSPPGAAFSSTLFLTIPRKKNGVLDDVRSSSWLDAMKSSSPTHKKITKDFNTVLASTDTDVTYRTWLLKYPSALKSFEQITNYAKGKRIALFLDYDGTLSPIVDNPDRAFMSDCMRATVRNVAKFFPTAIISGRSRDKVYNFVGLTELYYAGSHGMDIMGPVRHSISNDHPNCIRLTDKQGKEVNLFQPASEFLPMIDEVFRSLVRCTKEIKGAEVENNKFCVSVHYRNVDEKYWKTIAQCVDDILKDYPRLRLTHGRKVLEVRPVIDWDKGKAVEFLLESLGLNNSDDVLPIYVGDDRTDEDAFKFLRDGKRGYGILVSSVPKESNAFYSLRDPLEVMEFLKLLVMWKKSSAL

SEQ ID NO: 1131 - protein, 391 aa, Medicago truncatula
  misc_feature: Public GI ID no.144924741
  misc_feature: Bit score of 822.6 for HMM based on sequences of FIGURE 9.
  misc_feature (124)..(368): Pfam Name: Trehalose_PPase Pfam Description: Trehalose-phosphatase
  misc_feature: Functional Homolog Of Ceres SEEDLINE ID no. ME20095 at SEQ ID NO. 1129
MDLQPSHASPILTDPVSKSRLGIHSSLLAYSQQDSPLSPGKYTKSNSKKNMGSLDDVRSNGWLDAMKASSPPRKKSVLKGSSALVASIDFDMEDYNLWMLEYPSALGAFEKIIDHAKNKKIAMFLDYDGTLSPIVEDPDCAFMTEPMRTTVRRVAKCFPTAIISGRSRDKVFDLVKLTELYYAGSHGMDIIGPVSDTLHENHPDCVKSTDDQGNEITLFQPAKEFLPMIDEVFRTLIDITKDIEGAKVENHKFCVSVHYRNVEENNWTVIAQRVHDILKNYPRLRSTHGRKVLEIRPVIDWNKGKAVEFLLESLGLTDMNDVLPIYIGDDKTDEDAFKVLRESNRGCGILVSSVRKDSNALYSLRDTSEVMRFLQRLVNWKRKQERKHGKK

SEQ ID NO: 1132 - protein, 525 aa, Acidovorax sp. JS42
  misc_feature: Public GI ID no.121594508
  misc_feature: Bit score of 234.7 for HMM based on sequences of FIGURE 9.
  misc_feature (284)..(508): Pfam Name: Trehalose_PPase Pfam Description: Trehalose-phosphatase
  misc_feature: Functional Homolog Of Ceres SEEDLINE ID no. ME20095 at SEQ ID NO. 1129
MAIDDVDGNAPAPSANFDCGSFAAGIFDLDGVVTRTARVHAASWKRLFDDYLRQRAECTGEAFEPFNDADYRRYVDGKPRYEGVGSFLRSRGIELDYGTPADPPERETVCGLGNRKNILFQEQLAQTGVEVYDTSVAFLRRLRERGLKTALVSSSKNAAAVLEAAGLTGLFDACVDGIEAARLGLKGKPNPDIFLRACELLEVSAADAFAVEDALSGVEAAHAAGFGRVIGIDRTGERAALLAHGADLVVGDLAELEPVAALPDALESYEEIRQRLRAKRAAVFLDYDGTLTPIVARPELAVLSEEMRATVRELAQVCAVAVVSGRDRADVERLVGLDTLVYAGSHGFDIAGPGGLHMQHERAAEFLPALDRAESRLRKATKSVPGALVERKRYAIAVHYRLVAPDDLPVLEAAVDAALAETTDKLRKTGGKKVFELRPKLTWDKGRAVCWLLEALDLDGPEIVPLYLGDDETDEDAFEALGELHGIGLLVARAPQATAAQYGLEDPAAVARFLRTLITTLKAST

SEQ ID NO: 1133 - protein, 418 aa, Candidatus Kuenenia stuttgartiensis
  misc_feature: Public GI ID no.91202290
  misc_feature: Bit score of 249.7 for HMM based on sequences of FIGURE 9.
  misc_feature (179)..(401): Pfam Name: Trehalose_PPase Pfam Description: Trehalose-phosphatase
  misc_feature: Functional Homolog Of Ceres SEEDLINE ID no. ME20095 at SEQ ID NO. 1129
MGKLKNEYFLKHIGDHGAEVYDSTIDFIHSLKKQGCKTAIISSSRNCAMILDSTNLSSLFDVRVDGLDSEVLGIKGKPAPDIFLEAARQLKAKPERAVVIEDAISGVQAGKAGKFRLVVGVARTGDKESLLENGADVVVEDLSEIGVRNDIEVIHGLPSALDSIDDIANQARGKRIAVFLDYDGTLTPIVETPDKAIMAEDMREAVIKLSNNCTVGIISGRDLKDVQEKVEIDSFVYAGSHVFDIAGPEGLNIKSQAGAEFLPVLDKAEKELSEKLRSIEGVFVERKKFAIAIHYRLVTPEKAELVDEIVDKVASVYPELRKAYGKKIFELQPDIDWHKGKALLTLLKALKLDGDDVLPFYIGDDVTDEDAFWTLKGSGIGIVVWDEPYETAASYSLKNPEEVRKFLLKLIPLGGGHE

SEQ ID NO: 1134 - protein, 346 aa, Rhodoferax ferrireducens DSM 15236
  misc_feature: Public GI ID no.89900939
  misc_feature: Bit score of 222.5 for HMM based on sequences of FIGURE 9.
  misc_feature (104)..(328): Pfam Name: Trehalose_PPase Pfam Description: Trehalose-phosphatase
  misc_feature: Functional Homolog Of Ceres SEEDLINE ID no. ME20095 at SEQ ID NO. 1129
MNAKNPSSEQLDVKPARSVVVEEALAGVQAGRRAGFGMVVGVDRSGHAQELKDAGAHMVVTDLVEVSVAQEVAPARRRSDELPSALAALADIKARMKGRSPAVFLDYDGTLTPIVQSPELALLSDDMRDAVRTLARRCTVVVMSGRDLPDVQARVGLKDIVYGGSHGFEIFGPQGMHFEQEQGGEFLPQLDRAELALRERLGHVPGLLVERKKYAIAVHFRLVGESDLEAVEPAVNAVLAAHPKLRKTHGKMIFEVQPDIDWDKGRAMIWLLGKLGLAQSDVFVLYLGDDITDEDAFRSLNAQGNGIGILVRDEPRDTAAQYALGSIEEVRRFLTELATLTEGTRA

SEQ ID NO: 1135 - protein, 271 aa, Pelobacter carbinolicus DSM 2380
  misc_feature: Public GI ID no.77917672
  misc_feature: Bit score of 142.8 for HMM based on sequences of FIGURE 9.
  misc_feature (35)..(256): Pfam Name: Trehalose_PPase Pfam Description: Trehalose-phosphatase
  misc_feature: Functional Homolog Of Ceres SEEDLINE ID no. ME20095 at SEQ ID NO. 1129
MEFSPHKTMSHTLPSALECLATIQHMLQNKRGMVFLDYDGTLTPIVERPEWAQLSQKMRDAVNQLSQRCDVAIVSGRDLQDIRNLVGIEGILYAGSHGFDISGPGGHLELEQGIDYLPALDRAETALTKQLAEVAGTQIERKRFAIAVHFRRADPADVSQIETIVDTILEKNPGLRKTGGKMIFELRPDIDWDKGKALRWILARLGMHDDEVLPIYIGDDLTDEDAFCELQKRGIAILVSDEQRLTAANYVLNDPLEVEQFLKRLKVNQNS

SEQ ID NO: 1136 - protein, 1314 aa, Nitrosococcus oceani ATCC 19707
  misc_feature: Public GI ID no.77165252
  misc_feature: Bit score of 224.7 for HMM based on sequences of FIGURE 9.
  misc_feature (275)..(497): Pfam Name: Trehalose_PPase Pfam Description: Trehalose-phosphatase
  misc_feature: Functional Homolog Of Ceres SEEDLINE ID no. ME20095 at SEQ ID NO. 1129
MNSHKTISRSHFDAVIFDLDGVVTQTARVHATAWKTMFDDFLQKRAQGSEFRPFSDHDYRDYVDGKPRYEGVKSFLRSRHIKLPYGNPNDSLEKETVCGLGNRKNEIFQIKLKKEGAEAYQSSVQLIRRLRSKGFRTAVVSASKNCGPILESVELTHLFEVKVDGNDAEALDLQGKPHPATFLEAARRLGVEPKRCMVFEDAIAGVKAGRQGKFGRVIGVNRKNQVEALQEAGADTVIEDLAEMTLVARLCDLSPALEALESIQNRIAQREIVVFLDYDGTLSPIVSRPEEAHLSAEMNRTLRKLADQCPVAIISGRGLADVRQRVAIESLYYAGSHGFEIAGPEGLAMEQEQAKAYLPLLDETEQALAQQLENIVGAQIERKRFSIAIHYRNVAEDQIEAVEKAVDRVLGSHDRLHKKYGKKVYELQPAVAWDKGQALLWLLGKLKLNYPDVLPLYIGDDLTDEDAFQTLEEWGLGLVVGTETRHTYAEYRLKDPAQVREFLTALTRILQERSAWTLAYHRFEPKEEGLREALCTLGNGYFATRGAAPESRADATHYPGTYMAGGYNRLKTAIAGRTVENEDLVNWPNWLCVNFRPLGGKWLNLATMEILFYHQKLDIKQGLLRRVVHFRDPEGRETRVVQRRLVSMAHMHQAALETVITPLNWSGTLEVHSALDGQIRNSGVARYQALNSKHLEPVETRPVDERSFLLKVRTNQSHLIFAQAARLEVFQKNKRALVERQTEEETAYIAQAFITEITKETPLTVEKTVALYTARDSAISECGLEAIKAIQESPRFESLLEAHRLAWEHLWRQFDMRLEIIDDSGDHPIQRVLRLYSFHLLQSASMHSLDIDVGMPSRGWHGEAYRGHIFWDELIIFPFLNYRVPQITQALLMYRYRRLHEARRAAQALGYKGALYPWQSGSNGREESQQLHLNPRSGRWLPDHSYLQRHINAAIVYNIWQYFQVTGDLDFLACYGAEMILEIARFWASIATYNETLDRYEILGVMGPDEFHDAYPEMGSPGLNNNAYTNLMAVFVFNKALELFQLLPAQACQQLCEKLTIEESEKARWRDLSGKMRIVFHDDGIISQFEGYGELAEFDWESYREKYGNIQRLDRLLEAEGDTVNRYKASKQADVLMLFYLFSAPELGELFEQLGYIFKPEDIPKNIDYYLQRTSNGSSLSWIIHAWAATRRDRKHSWQLFQEALKTDVADIQGGTTPEGIHLGAMAGCIDLVQRCYTGLEARGQVLRFNPCFPEELRQLHMHLHYRGHWLELDISREKLKIESLTCGAAPVEIEVKGDRFSFKEGKVKEIELN

SEQ ID NO: 1137 - protein, 531 aa, Stigmatella aurantiaca DW4/3-1
  misc_feature: Public GI ID no.115375374
  misc_feature: Bit score of 201.9 for HMM based on sequences of FIGURE 9.
  misc_feature (290)..(513): Pfam Name: Trehalose_PPase Pfam Description: Trehalose-phosphatase
  misc_feature: Functional Homolog Of Ceres SEEDLINE ID no. ME20095 at SEQ ID NO. 1129
MQGSSLMASPSSTVVLSRHELDAVLFDLDGVVTRTARVHAAAWKRLFDAYLEGRARRTEGRFQPFTDEDYRRFVDGRPRLEGIRCFLESRGLSLPEGTPGDGPEAETVHGLGERKNAYFHEALAREGVEVYPPAVRLLEQIRAAGFRTAVVTSSRNGEAVLRAAGLEHLFDARVDGVEAGRLELPGKPAPDTFLEGARRLGVAPGRAAVLEDARSGVQAGRRGGFGCVIGVRRSGAEGALVKAGADVEVTELSSVGVEADLETRPMREVPLAMERREEWLRRMTGRVAVFLDYDGTLTPIVPVPEEAFLADSMRTTLEELARYVPVAIVSGRDLPMLKGFVKLQGLYFAGSHGFDIEGPGGRHFQQEEGKALLPELDAAERELTEALAGIPGAGVERKRFSVAVHWRHVEAARLPEVEQAVAGCQARHPKLTRSGGKKVFELRPGIDWHKGRAVEWLLKALGLEGEGVLPVFIGDDLTDEDAFRTLKGRGLGLVVRGDEERPTAADYALRDVEEVRRFLGVLIAHVGGAKR

SEQ ID NO: 1138 - protein, 276 aa, Geobacter sp. FRC-32
  misc_feature: Public GI ID no.110602449
  misc_feature: Bit score of 107.1 for HMM based on sequences of FIGURE 9.
  misc_feature (39)..(261): Pfam Name: Trehalose_PPase Pfam Description: Trehalose-phosphatase
  misc_feature: Functional Homolog Of Ceres SEEDLINE ID no. ME20095 at SEQ ID NO. 1129
MAGRGSGFVDQTSHQSLPSALANLQEILQLGRGRQLVIFLDYDGTIAPITPTPDSALITPEMHRAMLRLAAKCTVGVISGRDLPDVRQRVNIDSIVYAGSHGFEIGGPKGLHVEQPIGIQCLPTLDLTHQEISRQLAEVKGAIVERKRFVITVHYRLVAEQEVTLVEAAVDQAIHRHPQLRKTAGKKMFELLPNTDWNKGKAILSLLDILEMNGPEVLPIYLGDDTTDEDAFRALQGTGLGIFVGEEAVESAAGYGLRDWEEVREFLLELTPFCRV

SEQ ID NO: 1139 - DNA, 1760 bp, Zea mays
  misc_feature: Ceres CLONE ID no.1562633
  misc_feature: Encodes the peptide sequence at SEQ ID NO 1140
agtcctccgttctcctcttcctctctctctcttctctctctctctacggattgcctcacacgcatctcgcgtgcaattcaagcgaaactttctgaatatcaaagtggcatagagctccacttttatggccatccctatgaaggcctctccgggttcctgatatagatgtttccttgttctgaacatgaaaagttctcaggtactccgccgttgatgaactgcctccacacctgcggcgacaagaagacgctgaagaagtggtttttcatcgacaagacagtaggctaaatccagtcccagagaacaaattgaagcaccactccccaccgcacagcagcacagctcttctcttcaccgatcccgatggatatgggcagcggctcgtcacctgtcatcaccgatccgatatcgataagcccaccgctgctgggaggcttgacgtcgaacctgatgccgttctcggtcatgtccggaggctgctcctccagtcctagcatgagcgccagcagcaggcgtaaaatcgaggaggtccttgtcaatggcctgctagacgcgatgaaatcgtcgtcgcctcgcaagaagcacaacctcgccttcggacaggataattcgcccgacgaagatcctgcttacactgcatggctgtcaaaatgcccttctgcgctggcctccttcaagcagatagtagccaacgcacagggcaggaggatcgctgtgttcttggattacgacggcaccctgtcgccgatcgtcgacgatcccgacaaagcgttcatgtcccctgtgatgagagctgctgttagaaatgtcgcgaagtacttccctaccgcgattgtcagcggaaggtcccgtaagaaggtgtttgaatttgtaaaactgacggaactgtactacgctggtagtcacgggatggacatagtgacatctgcagcagcacatgctactgaaaagtgcaaagaagccaatctcttccaacctgcttgcgagtttctccctatgattaatgaggtttccaagtgcctcgtggaggtcacgagttcaattgaaggtgcaagagttgagaacaacaagttctgtgtatctgtacattaccgcaacgtagcagagaaggactggaaagtggtcgcaggactcgtgaaacaagtcttggaggccttccctcgtctcaaagtaaccaacgggcgaatggttttagaggttcgcccggtgatcgactgggacaagggaaaggctgtcgagttcctgcttcggtcgctcggcctaagcgactccgaagatgtggttcctatctacatcggagacgatcgaacagacgaagacgccttcaaggtactgcgagagcgaagctgtggatacggaatcctagtctcgcaggtgcccaaggacactgaagccttctactcgctgagagacccgtctgaagtgatggggttcctcaattccttggtgagatggaagaagcacccgctgtgacgcaactgaaaacacaacgactgattcagaagccgtaaagcgactgtacttcgtgcggcggcaattttgtagagtttttggctcaccgggtggctcattctttcatgcgtttttattttttatttttttaactgtcacagtccttcgtcactgagaaataacaagtggttgtcccacaccctcttgcaactgtaatctgtaagcaagaggccctccctgttcggtctatatatatatattgaataaaaccgggacgcttttgccttgccctaaaaaaaaaaaaaaaa

SEQ ID NO: 1140 - protein, 369 aa, Zea mays
  misc_feature: Ceres CLONE ID no.1562633
  misc_feature: Bit score of 890.9 for HMM based on sequences of FIGURE 9.
  misc_feature (119)..(352): Pfam Name: Trehalose_PPase Pfam Description: Trehalose-phosphatase
  misc_feature: Functional Homolog Of Ceres SEEDLINE ID no. ME20095 at SEQ ID NO. 1129
MDMGSGSSPVITDPISISPPLLGGLTSNLMPFSVMSGGCSSSPSMSASSRRKIEEVLVNGLLDAMKSSSPRKKHNLAFGQDNSPDEDPAYTAWLSKCPSALASFKQIVANAQGRRIAVFLDYDGTLSPIVDDPDKAFMSPVMRAAVRNVAKYFPTAIVSGRSRKKVFEFVKLTELYYAGSHGMDIVTSAAAHATEKCKEANLFQPACEFLPMINEVSKCLVEVTSSIEGARVENNKFCVSVHYRNVAEKDWKVVAGLVKQVLEAFPRLKVTNGRMVLEVRPVIDWDKGKAVEFLLRSLGLSDSEDVVPIYIGDDRTDEDAFKVLRERSCGYGILVSQVPKDTEAFYSLRDPSEVMGFLNSLVRWKKHPL

SEQ ID NO: 1141 - DNA, 1116 bp, Oryza sativa
  misc_feature: Ceres ANNOT ID no.1692728
  misc_feature: Encodes the peptide sequence at SEQ ID NO 1142
atggatttgagcaatagctcacctgtcatcaccgatccggtggcgatcagccagcagttgttgggcggcctgccttcaaatctgatgcagttttcagtcatgcccggtggctactccagctctggcatgaacgttggtgtcagtaggctcaaaatcgaggaagtccttgtcaatggactgcttgatgccatgaaatcctcgtcacctcgcaggaggctgaatgtagcatttggcgaggacaattcatctgaagaagaagaccctgcttacagcgcttggatggcaaaatgtccttctgctttggcttccttcaagcaaattgtagccagtgcacaagggaagaagattgctgtgtttctagactatgacggcacactgtcgcctattgtggatgatcctgacaaagcagtgatgtctcccgtgatgagagctgctgtgagaaatgttgcgaagtacttccccactgcaattgtcagcggaaggtcccgcaataaggtgtttgaatttgtaaaactgaaggagctttattatgctggaagccatggtatggacataatggcaccttcagcaaatcatgagcacagtgctgaaaagagcaaacaggccaatctcttccaacctgcacacgactttctgccaatgatcgatgaggttaccaagtccctcttgcaagttgtcagtggaattgaaggtgcaactgttgagaacaacaaattctgcgtttctgtacattatcgcaacgttgcagagaaggattggaaactggtcgcacggctcgtaaacgaagtgctggaggcttttcctcgtctcaaagtaaccaatggacgaatggttttagaggttcgtccggtgatcgactgggacaagggaaaggctgtggagtttctgctccagtcactcgggctaaatgactctgaaaatgtgatccccatctacattggagacgacagaactgacgaagacgctttcaaggtacttcgacagcgaaattgcggttatggaatactagtttcacaggttcccaaggaaactgaagccttctactcgctgagagatccatctgaagtgatggagttcctcaatttcttggtgagatggaagaagcactcagtgtga

SEQ ID NO: 1142 - protein, 371 aa, Oryza sativa
  misc_feature: Ceres ANNOT ID no.1692728
  misc_feature: Bit score of 896.0 for HMM based on sequences of FIGURE 9.
  misc_feature (119)..(354): Pfam Name: Trehalose_PPase Pfam Description: Trehalose-phosphatase
  misc_feature: Functional Homolog Of Ceres SEEDLINE ID no. ME20095 at SEQ ID NO. 1129
MDLSNSSPVITDPVAISQQLLGGLPSNLMQFSVMPGGYSSSGMNVGVSRLKIEEVLVNGLLDAMKSSSPRRRLNVAFGEDNSSEEEDPAYSAWMAKCPSALASFKQIVASAQGKKIAVFLDYDGTLSPIVDDPDKAVMSPVMRAAVRNVAKYFPTAIVSGRSRNKVFEFVKLKELYYAGSHGMDIMAPSANHEHSAEKSKQANLFQPAHDFLPMIDEVTKSLLQVVSGIEGATVENNKFCVSVHYRNVAEKDWKLVARLVNEVLEAFPRLKVTNGRMVLEVRPVIDWDKGKAVEFLLQSLGLNDSENVIPIYIGDDRTDEDAFKVLRQRNCGYGILVSQVPKETEAFYSLRDPSEVMEFLNFLVRWKKHSV

SEQ ID NO: 1143 - DNA, 1805 bp, Triticum aestivum
  misc_feature: Ceres CLONE ID no.921110
  misc_feature: Encodes the peptide sequence at SEQ ID NO 1144
cttcccggcccccgaaccacagaccccccaaccctgctcctcccccgcctcgccgttgacgcctccccttctggtggctcgcccgcgccggcattgggttcgtcccggagaaggtctccccgtccgtgttggctgtgactctactcaattattgtccttggagcgggcccgtcagatacaggagccttcctcttagggatatcaaccgggtttctcgcttgctgagttggctgcgtttcatgcacgtttgcagtgacgaaaagatccccgttttttttattgataagagggttggttgagtgttctctgtttcattcttcagtccggcactctacttctgttgttggtagtttgtagtttgacaacaagactgacaggaagtcttgtcctgtttatggatttgaagacaagccacaactctcctgtttttgttgatcctctcccttcactagccttgcctatgacgtacacaacacctactagcttcccatcttctgggctttacctgaacaccccaaagaagaaacctcttcccagcaagatcgaagaggttcgtgctgccggatggcttgatctgatgctcgcctcatcacctcctcgtaagaggcaaagcaaggacttcttaccccatgatgttcaagctgatgatcttgatttgcggtatcgtaattggatggtgaattatccttctgcgttaggctccttcgaggcaattactgagcttgcccgcgggaaaaatatggcattgtttcttgattatgatggaactctttcgcctattgtggacaatcctgcaaatgcagtaatgtctgacgagatgcgtgctgctgtgaggcatgtagcatcacttttcccgactgcaatcattagtggaagatctcgtgacaaggtatttgactttgtgaaactaaccgagctgtactacgccggaagtcatggaatggacatcatggggcctattaggaagtctgagtccaatggtcaccatgtggaatgtgttaggtccactgattcagagggtaaagaggtcaatctcttccaacctgcaagtgagtttttacctatgatagctgaggtgttcgaaaatcttagtgagagtataaagggcatcgaaggtgcaaggatggaagataacaagttctgcgtgtctgtgcattatcgaaacgttgcaccacatgactacgaaacagttcatcagcgtgtaactgctgttctgaaggattacccttgtcttaggcttacccatgggaggaaggttcttgaagttcgccctgtcattgactggaacaaggggaaagctgtggaatttttgcttgaatcgcttggactaaacgagagcgacgatgttcttcccatctatgtcggagatgacaagactgacgaagatgcattcaaggttctgaaagcgaacaaccatggctttggaattctggtttcatctgtgcccaaggacagtgatgccttctattccctgagggatccatctgaggtgatggaattcctgaggacattggcagcatggaaggagggttctagctgagcagacgggaagaacggttttgctgacctggagaagcccccaattatatatacaagctaaccaaataagttggctgatataagagagtcaggccaaagcttttttgatttggcattttgtaaatgtggctgccactttttttggcaccacttttcgtcttttgttaatgggacttatcagtttcattcttttattgttaaaagtttcttttagtatatatcaatataagctgaaatttttcctgctggcaaaaaaaaaaaaaaaa

SEQ ID NO: 1144 - protein, 381 aa, Triticum aestivum
  misc_feature: Ceres CLONE ID no.921110
  misc_feature: Bit score of 892.4 for HMM based on sequences of FIGURE 9.
  misc_feature (119)..(364): Pfam Name: Trehalose_PPase Pfam Description: Trehalose-phosphatase
  misc_feature: Functional Homolog Of Ceres SEEDLINE ID no. ME20095 at SEQ ID NO. 1129
MDLKTSHNSPVFVDPLPSLALPMTYTTPTSFPSSGLYLNTPKKKPLPSKIEEVRAAGWLDLMLASSPPRKRQSKDFLPHDVQADDLDLRYRNWMVNYPSALGSFEAITELARGKNMALFLDYDGTLSPIVDNPANAVMSDEMRAAVRHVASLFPTAIISGRSRDKVFDFVKLTELYYAGSHGMDIMGPIRKSESNGHHVECVRSTDSEGKEVNLFQPASEFLPMIAEVFENLSESIKGIEGARMEDNKFCVSVHYRNVAPHDYETVHQRVTAVLKDYPCLRLTHGRKVLEVRPVIDWNKGKAVEFLLESLGLNESDDVLPIYVGDDKTDEDAFKVLKANNHGFGILVSSVPKDSDAFYSLRDPSEVMEFLRTLAAWKEGSS

SEQ ID NO: 1145 - DNA, 1728 bp, Panicum virgatum
  misc_feature: Ceres CLONE ID no.1791180
  misc_feature: Encodes the peptide sequence at SEQ ID NO 1146
actccattctcctcttcctcctctctaggcgaattggatcgcgcatcccgtgttcatttcgactttgaagccctccattgcattaagtggtgctttctgaatatcgaatcgcgacagagtttggtttttatggccatccctatgaagcaatcgggattcctgatatagatgtttccttgttctgaacatgagaagttctcaggtattctgctgttgatgaactgcctccacacctgcagtgacaagaaaacgctgaagaagtggtttttcatcgacaagacagtaggctgaattccagtacagagaaagaaacaacgctcgacacatttttttccttgattcatccgtcatccccaatggatatgagcaccagctcacctgtcatcaccgatccggtatcgataagccccccactgttaggaagcttgacgtcaaacatgatgccgttttcagtcatgtccggaggctgctccagtcccggcatgaacgtgagcgccagtaggcgtaagatcgaagaggtccttgtcaatggcctgttggatgcaatgaaatcctcatcgccgcgcaagaagcacaatcttgccttcggcccgggcggttcacctgacgaagatcctgcttatactgcatggatgtcaaaatgcccttctgctctgacgtccttcaagcagatagtagccaatgcacatggaaggaagattgctgtgtttttggattacgatggtaccttatcgcctatagtggatgatcccgacaaagcattcatgtcccccgcgatgagagctgctatgagaaatgttgcaaagtacttccctacagcaattgtcagcggaagatcccgcaagaaggtgtgtgaatttgtaaaactgaaggaactatgctatgccggaagtcatgggatggacatagtgacatctgcaccagaacacaatactgaaaagggcaaagaagccaatctcttccaacctgctttggagttccttcctatgattgatgaggtttccaaatccctcttggaggccacaagtggaattaaaggtgcgaatgttgagaacaacaagttctgtgtatctgtacattaccgcaacgtagcagagaaggactggaaagtggttgcacgactcgtaaacgaagtcttggaggcctttcctcgtctcaaagtaaccaatggacgaatggttttagaggttcgtccagtgatcgactgggacaagggaaaggccgtcgagttcctgcttcaatcgctcggcttaaacgattctgaaaatgtgattcccatctacatcggagatgatcgaacagacgaagacgcattcaaggtacttcgaaagcgaaactgtggatacgggatactagtttcccaggtgcccaaggacactgaagccttctactcgctgagagacccatctgaagtgatggcgttcctcaattccttggtgagatggaagaagcactcactgtgacgaaaccgaaaaatacgattggttgatccagaagtcgtgaaaataactgtagttcgtgctggcggcaattttgtagagttggacacaacgggtggctcattctttcatgtctatcattgttttcttttgtttggttcgtgctctgctctttgccactgagaaatgatcagtggttgcctcgccctcttgcaactgttatttgtaagcaagaggggcctcttttccttttcagactggtgaataaaactgagacgcttaacttgtt

SEQ ID NO: 1146 - protein, 368 aa, Panicum virgatum
  misc_feature: Ceres CLONE ID no.1791180
  misc_feature: Bit score of 892.6 for HMM based on sequences of FIGURE 9.
  misc_feature (118)..(351): Pfam Name: Trehalose_PPase Pfam Description: Trehalose-phosphatase
  misc_feature: Functional Homolog Of Ceres SEEDLINE ID no. ME20095 at SEQ ID NO. 1129
MDMSTSSPVITDPVSISPPLLGSLTSNMMPFSVMSGGCSSPGMNVSASRRKIEEVLVNGLLDAMKSSSPRKKHNLAFGPGGSPDEDPAYTAWMSKCPSALTSFKQIVANAHGRKIAVFLDYDGTLSPIVDDPDKAFMSPAMRAAMRNVAKYFPTAIVSGRSRKKVCEFVKLKELCYAGSHGMDIVTSAPEHNTEKGKEANLFQPALEFLPMIDEVSKSLLEATSGIKGANVENNKFCVSVHYRNVAEKDWKVVARLVNEVLEAFPRLKVTNGRMVLEVRPVIDWDKGKAVEFLLQSLGLNDSENVIPIYIGDDRTDEDAFKVLRKRNCGYGILVSQVPKDTEAFYSLRDPSEVMAFLNSLVRWKKHSL

SEQ ID NO: 1147 - DNA, 1522 bp, Glycine max
  misc_feature: Ceres CLONE ID no.527891
  misc_feature: Encodes the peptide sequence at SEQ ID NO 1148
gatgtgaccaaccattgctttctcttttcagttctcttctcctctctgcgcgacacagcacttcgtcactttcctttttttccattctcatagcgtttttgtgttttcaagcaagcgagaactcatctgttgataaactgctacctcaagcagtgacaagaaaagtggtggaagtttgatagactttatagttcaatttgttctgaatactccttaaaaaaaaaggtcttacattgttgctgcactgtgaaattgtgcatagacctggatccaatggacctgaagccaaatcttaaccctgtccttactgatgccacacccttaacaaggtcaaggctgggtgtgccttctggtttatcaccttactctcctataggggcaacctttccccatggtaacatgctggcaattccaaggaagaagacaggaattcttgacgattttcgttctagcggttggctcgatgcaatgaaatcgtcttctcctactcacactaaggtatccaaggatgttagtcatgggattggatcacctgattctgcttatagtacctggctgctaaagtttccatcagcactagcatcttttgatcaaattaccaactgtgcaaaagggaagagaatagcattgtttctggattatgatgggactctttcacccattgtggataatcctgactctgctttcatgtcagacaatatgcgtgctgctgttaaaatagtggcggaatattttccaaccgcgataattagtggaagaagccgtgacaaggtatatgaatttgttggagtaagtgatctatgttatgctggtagtcatggtatggacattattggtccttctagacaatctatttctgataatcaccctgattgcattagttctgctgacaagcagggtgttcaagttaatttattccaacctgctgctgaattcctgcccatgattaatgaggtacttgggttgctcaaggagtgcacagaagatattgaaggagcaacagttgagaacaacaaattttgtgtgtctgtgcattaccgcaatgtagatgaggagagttggcaaattgtgggacaacgtgtatatgatgttctgaaggagtatccacgtttgcgtttaactcatgggcggaaggttttagaggttcggccagtgattgactgggataagggaaaagctgtcacatttttactcgagtcacttggacttaattgtgatgacgtgctcgctatttatgttggggatgatagaacagatgaagatgcatttaaggttttgaaagaagctaataaaggttgtggcatcttagtgtcccgtgccccaaaagaaagcaacgcaatttactctcttcgtgatccctctgaggtcatggaatttctgacatcacttgcggaatggaaatcaagcattcaagctcgctgaaaagatttacatattgtatagaggagaacatactccactatgctatatattagagacagtcttttgtttttagtttgaattttttgttagaagactttcc

SEQ ID NO: 1148 - protein, 382 aa, Glycine max
  misc_feature: Ceres CLONE ID no.527891
  misc_feature: Bit score of 933.1 for HMM based on sequences of FIGURE 9.
  misc_feature (120)..(363): Pfam Name: Trehalose_PPase Pfam Description: Trehalose-phosphatase
  misc_feature: Functional Homolog Of Ceres SEEDLINE ID no. ME20095 at SEQ ID NO. 1129
MDLKPNLNPVLTDATPLTRSRLGVPSGLSPYSPIGATFPHGNMLAIPRKKTGILDDFRSSGWLDAMKSSSPTHTKVSKDVSHGIGSPDSAYSTWLLKFPSALASFDQITNCAKGKRIALFLDYDGTLSPIVDNPDSAFMSDNMRAAVKIVAEYFPTAIISGRSRDKVYEFVGVSDLCYAGSHGMDIIGPSRQSISDNHPDCISSADKQGVQVNLFQPAAEFLPMINEVLGLLKECTEDIEGATVENNKFCVSVHYRNVDEESWQIVGQRVYDVLKEYPRLRLTHGRKVLEVRPVIDWDKGKAVTFLLESLGLNCDDVLAIYVGDDRTDEDAFKVLKEANKGCGILVSRAPKESNAIYSLRDPSEVMEFLTSLAEWKSSIQAR

SEQ ID NO: 1149 - DNA, 1164 bp, Populus balsamifera subsp. trichocarpa
  misc_feature: Ceres ANNOT ID no.1522414
  misc_feature: Encodes the peptide sequence at SEQ ID NO 1150
atggacctcaaatcaaatcataatgctcctgtgctcactgattctgctcccctaagcaagtcaaggctacgcgggtaccaccatggtttgatgctgccgtactcaccctcaggtgcacctttctcgtcaaatctattactatctattcctaggaggaaaactggagtgcttgatgatgttcgctcctgtggttggctggatgccatgaaatcatcatctcctactcataagaagtttgccaaggatattaaccatgagctttccgcacctgatccagaagttgcctatcgcacctggctgcttaaatatccatctgcgcttgcatctttcgagcaaattgcaaactttgcaaaaggcaagagaatcgccttatttctggattatgatggtactctttcaccaattgttgaaaatcctgacaatgccttcatgtctgctgatatgcgttccattgtaaaggaagtggcaaaatatttcccaacagcaataatcagtggaagaagccgtgacaaggtgtatgagtttgtagggcttacagaactctactatgcgggtagtcatggtatggatatcatgggccctgtcaggcaatctgtatctgacgaccaccgaaattgtatcaagtctacggacaagcagggcaacgaagttaacttattccagcctgcaagagaatttttacctatgattgacgaggtttatagttcccttgtcaggattaccgaagatattaaaggggcaacagttgagaacaataaattctgtgtctctgtacattaccgtaacgttgatcaagataactggaaatcagttggggagcgtgtccaggatgtcataaagaagtatcctcgcctgcgattgactcatgggaggaaggttttagaaatccgtcccgcgatcaattgggacaaggggaaagctcttgaatttctacttgaatcactagatctcagcaattgtgatgatgtgctgccgatttatgttggagatgaccggacagatgaagatgcatttaaggttttgagagagaggaactgtggttatggcatttttgtatcaaaatcaccgaaggaaagcaatgcgtattactctctcagagacccagcagaggtcatggagtttctcaagtccctggtgacatggaagaaatcgagtgctttataa

SEQ ID NO: 1150 - protein, 387 aa, Populus balsamifera subsp. trichocarpa
  misc_feature: Ceres ANNOT ID no.1522414
  misc_feature: Bit score of 975.0 for HMM based on sequences of FIGURE 9.
  misc_feature (125)..(369): Pfam Name: Trehalose_PPase Pfam Description: Trehalose-phosphatase
  misc_feature: Functional Homolog Of Ceres SEEDLINE ID no. ME20095 at SEQ ID NO. 1129
MDLKSNHNAPVLTDSAPLSKSRLRGYHHGLMLPYSPSGAPFSSNLLLSIPRRKTGVLDDVRSCGWLDAMKSSSPTHKKFAKDINHELSAPDPEVAYRTWLLKYPSALASFEQIANFAKGKRIALFLDYDGTLSPIVENPDNAFMSADMRSIVKEVAKYFPTAIISGRSRDKVYEFVGLTELYYAGSHGMDIMGPVRQSVSDDHRNCIKSTDKQGNEVNLFQPAREFLPMIDEVYSSLVRITEDIKGATVENNKFCVSVHYRNVDQDNWKSVGERVQDVIKKYPRLRLTHGRKVLEIRPAINWDKGKALEFLLESLDLSNCDDVLPIYVGDDRTDEDAFKVLRERNCGYGIFVSKSPKESNAYYSLRDPAEVMEFLKSLVTWKKSSAL

SEQ ID NO: 1151 - protein, 352 aa, Oryza sativa subsp. indica
  misc_feature: Public GI ID no.125540573
  misc_feature: Bit score of 807.6 for HMM based on sequences of FIGURE 9.
  misc_feature (119)..(335): Pfam Name: Trehalose_PPase Pfam Description: Trehalose-phosphatase
  misc_feature: Functional Homolog Of Ceres SEEDLINE ID no. ME20095 at SEQ ID NO. 1129
MDLSNSSPVITDPVAISQQLLGGLPSNLMQFSVMPGGYSSSGMNVGVSRLKIEEVLVNGLLDAMKSSSPRRRLNVAFGEDNSSEEEDPAYSAWMAKCPSALASFKQIVASAQGKKIAVFLDYDGTLSPIVDDPDKAVMSPVMRAAVRNVAKYFPTAIVSGRSRNKVFEFVKLKELYYAGSHGMDIMAPSANHEHSAEKVTKSLLQVVSGIEGATVENNKFCVSVHYRNVAEKDWKLVARLVNEVLEAFPRLKVTNGRMVLEVRPVIDWDKGKAVEFLLQSLGLNDSENVIPIYIGDDRTDEDAFKVLRQRNCGYGILVSQVPKETEAFYSLRDPSEVMEFLNFLVRWKKHSV

SEQ ID NO: 1152 - protein, 370 aa, Oryza sativa subsp. indica
  misc_feature: Public GI ID no.125561519
  misc_feature: Bit score of 669.6 for HMM based on sequences of FIGURE 9.
  misc_feature (114)..(348): Pfam Name: Trehalose_PPase Pfam Description: Trehalose-phosphatase
  misc_feature: Functional Homolog Of Ceres SEEDLINE ID no. ME20095 at SEQ ID NO. 1129
MTKQSVVLPEVAVPVPPNSAPLLPYPPPRAAPGVAVRKKYLQAQLDLGAGLPLINGWVESMRASSPTHAKAAAALAAAGAVDDERAAWMVRHPSALSKFEQIVAASKGKKIVMFLDYDGTLSPIVDDPDSAFMSDTMRRAVRSVAKHFPTAIVSGRCRDKVFEFVKLAELYYAGSHGMDIKGPAKASRHNKAKAKGVLFQPASEFLPMIEQVHDSLIERTKCIPGAKVENNKFCVSVHFRCVDEKSWSTLADIVKAELKDYPKLKLTQGRMVFEIRPTIKWDKGKALEFLLESLGFADCTNVLPVYIGDDRTDEDAFKVLRKRGQGIGILVSKYPKDTNASYSLQEPAEVMEFLLRLVEWERLSRARPKW

SEQ ID NO: 1153 - protein, 357 aa, Oryza sativa subsp. indica
  misc_feature: Public GI ID no.125528345
  misc_feature: Bit score of 628.8 for HMM based on sequences of FIGURE 9.
  misc_feature (103)..(330): Pfam Name: Trehalose_PPase Pfam Description: Trehalose-phosphatase
  misc_feature: Functional Homolog Of Ceres SEEDLINE ID no. ME20095 at SEQ ID NO. 1129
MGIAAGAALPGGPAGPAGGLFACRSAAASMRQTYLDLAAAAVAARSASCTSWADAMRASSPTRSSRSASDVDEFTAWVRKHPSALSKFEEIAAKSRGKKIVMFMDYDGTLSPIVADPDTAYMSDAMRAAVREVAKTFPTAIVSGRCRDKVRNFVGLSDLYYAGSHGMDIKGPSSNPESALCQPASEFLPMIDEVYKTLVEKTKSTPGAKVENNKFCLSVHFRCVDEKRWNALGEQVKAVIKEYPKLKLTQGRKVLEIRPSIKWDKGKALEFLLESLGFANCGDVLPVYIGDDRTDEDAFKVLRKRGQGLGILVSKCPKDTNASYSLQDPTEVMEFLLRLVEWKRKSSSSSLMIRPRV

SEQ ID NO: 1154 - protein, 349 aa, Oryza sativa subsp. indica
  misc_feature: Public GI ID no.116310408
  misc_feature: Bit score of 574.7 for HMM based on sequences of FIGURE 9.
  misc_feature (94)..(329): Pfam Name: Trehalose_PPase Pfam Description: Trehalose-phosphatase
  misc_feature: Functional Homolog Of Ceres SEEDLINE ID no. ME20095 at SEQ ID NO. 1129
MKISANFLLNNCARTYTNKKTLKKCKRELVEVVDGLVGVMMTSSNREKPDIESGYDDSSDEDSTENSRAEICPSALCFFDQIVASAQDKKVVLFLDYDGTLSPIVNDPEKAFMSSEMRATVKSVAKHFPTAIVSGRSRDKVFDFVKLTEIYYAGSHGMDILASFADSDSTIEKTKETKLFQPANEFLTMITEVSKSLIEVTKAIKGATVENNKFCVSVHYRNVDKKNWKLVAQVVNNVLKDFPSLKVSTGRKVLEVRPMINWDKGKAVEFLLRSLGLDDSETVLPIYIGDDKTDEDAFKVLRERKNGCGILVSQVPKKSEAFFMLRGPSEVVILPVMLNFFAALLIMPS

SEQ ID NO: 1155 - DNA, 1396 bp, Arabidopsis thaliana
  misc_feature: Ceres CLONE ID no.255364
  misc_feature: Encodes the peptide sequence at SEQ ID NO 1069
aatgtattaagacttgacaacttgtctttctcacaccaaacccctctcctctgtttcataacatcttctctttttttttttcctaagcccctaatgacaaaccataatgccttaatctctgatgctaaaggcagcatcggagttgcggttagagttccaaaccaatctctgttttctcccggaggtggccgatacatcagcattccccggaagaaactcgtgcagaagctagaggccgacccgagtcaaacccgtatccacacttggatcgaagccatgagggcttcttccccaacccgtacccgaccggggaacatatctcccctcacggagtccgatgaggaggatgaatactcttcttggatggctcaacacccgtcagctttaaccatgtttgaagagatagctgaagcttcaaaagggaaacaaatcgtgatgtttctcgactatgacggtacattatcccccattgttgaaaaccctgatcgagcttacatgtctgaagagatgagagaggcagtgaaaggcgtggctagatatttcccgaccgcgattgtcactggaagatgccgtgataaggttcgtagatttgtgaaacttcccggactttactatgcaggtagccatggaatggacatcaaaggaccttccaaaagaaacaaacataataagaacaataaaggagttcttttccaagcggcgaatgagtttttgcctatgattgacaaggtctctaagtgtctagtagagaaaatgagagacatagaaggagcaaacgtcgagaacaacaagttttgtgtctccgtacattaccgttgtgttgatcaaaaggactggggattggtagcggaacacgtgacatcgatattgagtgagtatccgaaactgagtttgacacaaggaagaaaagtcttagagattcgaccaaccatcaaatgggataaaggcaaagctctcgagttcttgctcgaatccttaggattcgctaactctaacgatgttttgcccatctatataggagatgatcgtacggacgaggatgctttcaaggttttgagaaacaaaggacaaggctttggtatacttgtgtccaaaattccaaaggaaacgagtgctacatattctctacaagaaccttccgaggtaggagagtttttgcagcgactcgtggaatggaaacaaatgtcactaagaggaagatagccaatttcctgacataaatttattttcaattaataaatgaattagttttcactatgcaacaaaaattgttgtatatatgatcaatgtttttttaattattttactcttcatgaacaaatgtaagtttataggaactttcttaaccaagaaaaaaagtaagtttgctatataatattttcatcattctcttttt

SEQ ID NO: 1156 - protein, 382 aa, Oryza sativa subsp. japonica
  misc_feature: Public GI ID no.115483332
  misc_feature: Bit score of 849.9 for HMM based on sequences of FIGURE 9.
  misc_feature (120)..(365): Pfam Name: Trehalose_PPase Pfam Description: Trehalose-phosphatase
  misc_feature: Functional Homolog Of Ceres SEEDLINE ID no. ME20095 at SEQ ID NO. 1129
MDLKTSNSPVIADPLPKLALPSAVMTYTTPTSFPSTGLYLNTPKKKPLPGKIEEVRAAGWLDLMLASSPPRKRQTKDFANDVQADELDLLYRNWVVNHPSALTSFEDIVNLARGKRLALFLDYDGTLSPIVDNPENAVMSDEMRSAVKHVASLFPTAIISGRSRDKVFDFVKLTELYYAGSHGMDIMGPVRKSDSSGQHVECIRSTDSEGKEVNLFQPASEFLPMISEVYKKLSESIKDIDGARMEDNKFCVSVHYRNVAPHDYGEVHQRVTAVLKNYPCLRLTHGRKVLEVRPVIDWNKGKAVEFLLESLGLCGKEDVLPIYVGDDKTDEDAFKVLKANSIGFGILVSSVPKDTDAFYSVRDPAEVMEFLKKLASWKEEST

SEQ ID NO: 1157 - protein, 358 aa, Oryza sativa subsp. japonica
  misc_feature: Public GI ID no.125575640
  misc_feature: Bit score of 786.1 for HMM based on sequences of FIGURE 9.
  misc_feature (96)..(341): Pfam Name: Trehalose_PPase Pfam Description: Trehalose-phosphatase
  misc_feature: Functional Homolog Of Ceres SEEDLINE ID no. ME20095 at SEQ ID NO. 1129
MTYTTPTSFPSTGLYLNTPKKKPLPGKIEEVRAAGWLDLMLASSPPRKRQTKDFANDVQADELDLLYRNWVVNHPSALTSFEDIVNLARGKRLALFLDYDGTLSPIVDNPENAVMSDEMRSAVKHVASLFPTAIISGRSRDKVFDFVKLTELYYAGSHGMDIMGPVRKSDSSGQHVECIRSTDSEGKEVNLFQPASEFLPMISEVYKKLSESIKDIDGARMEDNKFCVSVHYRNVAPHDYGEVHQRVTAVLKNYPCLRLTHGRKVLEVRPVIDWNKGKAVEFLLESLGLCGKEDVLPIYVGDDKTDEDAFKVLKANSIGFGILVSSVPKDTDAFYSVRDPAEVMEFLKKLASWKEEST

SEQ ID NO: 1158 - protein, 370 aa, Oryza sativa subsp. japonica
  misc_feature: Public GI ID no.115476368
  misc_feature: Bit score of 669.2 for HMM based on sequences of FIGURE 9.
  misc_feature (114)..(348): Pfam Name: Trehalose_PPase Pfam Description: Trehalose-phosphatase
  misc_feature: Functional Homolog Of Ceres SEEDLINE ID no. ME20095 at SEQ ID NO. 1129
MTKQSVVVPEVAVPMPPNSAPLLPYPPPRAAPGVAVRKKYLQAQLDLGAGLPLINGWVESMRASSPTHAKAAAALAAAGAVDDERAAWMVRHPSALSKFEQIVAASKGKKIVMFLDYDGTLSPIVDDPDSAFMSDTMRRAVRSVAKHFPTAIVSGRCRDKVFEFVKLAELYYAGSHGMDIKGPAKASRHNKAKAKGVLFQPASEFLPMIEQVHDSLIERTKCIPGAKVENNKFCVSVHFRCVDEKSWSTLADIVKAELKDYPKLKLTQGRMVFEIRPTIKWDKGKALEFLLESLGFADCTNVLPVYIGDDRTDEDAFKVLRKRGQGIGILVSKYPKDTNASYSLQEPAEVMEFLLRLVEWERLSRARPKW

SEQ ID NO: 1159 - protein, 464 aa, Oryza sativa subsp. japonica
  misc_feature: Public GI ID no.115478841
  misc_feature: Bit score of 522.1 for HMM based on sequences of FIGURE 9.
  misc_feature (150)..(413): Pfam Name: Trehalose_PPase Pfam Description: Trehalose-phosphatase
  misc_feature: Functional Homolog Of Ceres SEEDLINE ID no. ME20095 at SEQ ID NO. 1129
MAKASVVVPEQVGAAAAAQVGCPCPGTTLFPYPPPRAGIAVRRKCLQAAQQLELGAGLRGGWVESMRASSPTHAKAAAALAAGVDEEHAAWMVRFRSPIDRCSSRSWRARADTDMNRAFPFVFVQARHPSALGEFEKVVAASKGKQIVMFLDYDGTLSPIVDDPDAAFMSETVSLSSPPLSPTLLLHSSSSHTSLLPHQMRMAVRSVAKHFPTAIVSGRCRDKVFEFVKLAELYYAGSHGMDIKGPASRHAAAKSPPHNKGVLFQPASEFLPMIEQVHQRLEQATSSIPGAKVENNKFCVSVHFRCVDEKSWGALAETVRRVVREFPRLRLSQGRMVFEVRPTIKWDKGKALEFLLDSLGFADCSDVLPVYIGDDRTDEDAFKVLRRRGQGVGILVSKHPKETSASFSLQEPAELKKSSVHYPLPAQRSNRLNRILVNWWGEGLKDKLCALEPSHEREGCMAPH

SEQ ID NO: 1160 - protein, 596 aa, Oryza sativa subsp. japonica
  misc_feature: Public GI ID no.115467158
  misc_feature: Bit score of 536.9 for HMM based on sequences of FIGURE 9.
  misc_feature (120)..(351): Pfam Name: Trehalose_PPase Pfam Description: Trehalose-phosphatase
  misc_feature: Functional Homolog Of Ceres SEEDLINE ID no. ME20095 at SEQ ID NO. 1129
MTNQDVVMPDIAAAAAMPGSSGRAPLFACRGAAAVSASSMLGGGGAAYQAAVVAHVAPVPAIRPCASWVVEAMRASSPTRPAAAAVDAEYDAWTQRKHPSALGSFEQVAAAASGKRVVVFLDYDGTLSPIVADPDMAFMSDEMRAAVRDVAEHFPAAIVTGRCVDKVQSFVGLPELYYAGSHGMDIKGPSSNEEEDTKILLQPAREFLPVINKAYKALMEKTKSTPGARVENNKFCLSVHFRCVDEKRWNPLAEQVKAVLRDYPELKLTQGRKVLEIRPSIMWDKGKAVEFLLKSLGFDDDRRDVLPVYIGDDRTDEDAFKVLRKRGQGLGILVSKCAKETDASYSLQDPAEKYTNAGAHVFVTMLLTVVFTAAVALALVNAVNSHDFAAHLAGVDCRMGLAGPVRCPASGFVELLVLALHVMRARHLRSPACLPNVALATAFDCISMYVRRWQRGEVTNVHEVYVLSRIEFVPYMASTGEQRSTGETAVGAAAAGMYRMVPLHAAKWGDKWRMSGERMAAGVDCRRREDLPSSGDGYRQEEIDGGHGVPCSIGAVEASAIIVSDAPEGLISTLTTDHIYYMTVFPAKLALTSEEV

SEQ ID NO: 1161 - protein, 365 aa, Brassica rapa subsp. pekinensis
  misc_feature: Public GI ID no.72384477
  misc_feature: Bit score of 676.1 for HMM based on sequences of FIGURE 9.
  misc_feature (107)..(341): Pfam Name: Trehalose_PPase Pfam Description: Trehalose-phosphatase
  misc_feature: Functional Homolog Of Ceres SEEDLINE ID no. ME20095 at SEQ ID NO. 1129
MVSFVVEKPQRMSNGVVSETTRLSIIPNNSSSAQKTLLKNLEIINGGQRVNAWVDSMRASSPTHLKSLPSSVSSEKHLSSWIMQHPSALEMFEKITQASGGKQIVMFLDYDGTLSPIVDDPDKAFMSSKMRRTVKKLAKCFPTAIVTGRCIDKVYNFVKLAELYYAGSHGMDIKGPAKGFSRHKRVKQSLLYQPASDYLPMIDEVYKQLLEKTKSTPGVIVENHKFTASVHFRCVEEKKWSELVLQVRSVLEKYPTLKLSQGRKVFEIRPMIDWDKGKALEFLLESLGFGNSNNVFPVYIGDDRTDEDAFKMLRVRGEGFGILVSKFPKDTDASYSLQDPSEASPHTRILYLSVPKYKMFSRADL

SEQ ID NO: 1162 - protein, 344 aa, Ostreococcus tauri
  misc_feature: Public GI ID no.116054703
  misc_feature: Bit score of 261.3 for HMM based on sequences of FIGURE 9.
  misc_feature (78)..(321): Pfam Name: Trehalose_PPase Pfam Description: Trehalose-phosphatase
  misc_feature: Functional Homolog Of Ceres SEEDLINE ID no. ME20095 at SEQ ID NO. 1129
MSYKDMGRAGPLEIRTRGPPFGGLPQAQAGMKRSDSIGTIEKYWDDDAEWYEFHPNALAREGDGKFKELAVGKLLTVFLDYDGTLTPIVDEPDKAFMDDEVREAVRQCARRFPTAIISGRSRHKVSQFVQLEELYYAGSHGLDIAGPTRTSDGTPITATALAHQPAQWARDVMDRVTNDLIEKTRDIPGANIEHNMFCVSAHYRGVSDADRPRFQKIVDEIVASDECLIKHDGKMVWEVRPRVAWDKGKALSYLRDALIPDLAKKGFGSEEVFTVYVGDDVTDEDAFMEINEKLGDHLGVGVLVSHAPKVSAAKFSLRNTPEVLQFLTTLSKLADAGEVKTLPR

SEQ ID NO: 1163 - DNA, 1891 bp, Panicum virgatum
  misc_feature: Ceres CLONE ID no.1786317
  misc_feature: Encodes the peptide sequence at SEQ ID NO 1164
cttccccgtttcggctcccaaaatccccctcctccgtcgccgcctcccgtccggtcgtctccccgcctcgttggacgttgggtggctcgccggcgcctgcattggggataatctcgccgcctctgtccgagtgcaggatctttgcgtttaatgggctggacgcagtacatgcatgtttgcagtgacaagaagacattgaaacgctggtttttcatagacaagagggttggttaagtgctcagttctgtggaaaattctgcattctggtgcactgactttgtgtagcttctaactgctcttacaacaagacttgaagggggagggagagtcgtgtcttgttgatggatttgaagacaggcctcaactcacctgttattgcagatcatctccctacattagccttgcctgctcctgtcatgactttcacaacacctactagcttcccctctccggggctttgcttgaatactacaaagaagacacctctgcctggtaagatcgaagaagttcgtgccactggatggctcgaccttatgatggctgcatcacctacccgcagaaggcagatcaaggatgtcgtcaatgacactcaagctgatgatctcgatttgcaatatcataactggatggttgactatccatctgctttgacctcatttgaggcaattactgatcttgctgggagtaaaagattggtattgtttcttgactacgatggaacgctttcaccaattgtggacaatcctgaaaatgcattaatgtctgatgagatgcgagctgctgtgaagcatgtggcatcacttttcccaactgcaatcatcagtggaaggtctcgggataaggtttttgactttgtcaagcttaatgaactacactatgctggaagtcacggaatggacataatgggccctattaggaagactgctgactccaatggcgtggaatgcattcactccactgatttgaagggtaaggaggtcaaccttttccaacctgcaagtgagtttttacccatgatcagtgaggtgtataaaaagcttggtgagagtgtcaaggacattaatggtgccaggatggaagacaacaagttctgtgtctctgtgcattaccgtaatgtggcagaagatgactataaaaaggttttccagcgtgtaactgctgttttggaagattacccttgcctaaggctaacccatggaaggaaggtttttgaggtccgtcctgtgattgattggaacaaaggtaaagctgtggagtttttactcgaatctcttgggctcaatgagagtgaagatgttctccctatctatgttggagatgacagaactgatgaagatgcattcaaggttctgaaggcaagcaaccgtggctttggaatactggtgtcatctatacccaaggagagcgatgccttctactctttgagggatccagctgaggtgatggaattcctgagaaagctggcacaatggaaggagcaatccatctgagagttgaaaaacattggtttggttggtctggtccaagagtataaatagttacaatgctaaccaaataagtcggctatttggaggagtcaggccaaaatgtttttgatttggcattttataagaggctattgcatttttctgtcccactttgttctcgtgtcagggtttctcaagcaaattcaattctttcattatttaggttcctttagtatatacggagatatttttaaaagaattttggttcctactagtgtttcgctgcctcgcagttttactgtaggtaattatctattccatgttgtattcgtgaagatgtaaagaactggttctttgtttaaacagcggttagctgtcaatgtgctataaatgtcgaagttgcgagcaaaaaaaaaaaaaaaaaa

SEQ ID NO: 1164 - protein, 382 aa, Panicum virgatum
  misc_feature: Ceres CLONE ID no.1786317
  misc_feature: Bit score of 816.6 for HMM based on sequences of FIGURE 9.
  misc_feature (121)..(365): Pfam Name: Trehalose_PPase Pfam Description: Trehalose-phosphatase
  misc_feature: Functional Homolog Of Ceres SEEDLINE ID no. ME20095 at SEQ ID NO. 1129
MDLKTGLNSPVIADHLPTLALPAPVMTFTTPTSFPSPGLCLNTTKKTPLPGKIEEVRATGWLDLMMAASPTRRRQIKDVVNDTQADDLDLQYHNWMVDYPSALTSFEAITDLAGSKRLVLFLDYDGTLSPIVDNPENALMSDEMRAAVKHVASLFPTAIISGRSRDKVFDFVKLNELHYAGSHGMDIMGPIRKTADSNGVECIHSTDLKGKEVNLFQPASEFLPMISEVYKKLGESVKDINGARMEDNKFCVSVHYRNVAEDDYKKVFQRVTAVLEDYPCLRLTHGRKVFEVRPVIDWNKGKAVEFLLESLGLNESEDVLPIYVGDDRTDEDAFKVLKASNRGFGILVSSIPKESDAFYSLRDPAEVMEFLRKLAQWKEQSI

SEQ ID NO: 1165 - DNA, 1772 bp, Panicum virgatum
  misc_feature: Ceres CLONE ID no.1791336
  misc_feature: Encodes the peptide sequence at SEQ ID NO 1166
acacaccccctccctcctcgccatcctcccacctccgctctcccagtctccggccgcgttccagcaccagcgctgaagccgctagctagccgttgctcggctcccccgacaccaccaaggctttcccttcgatcgatcgaccagcaactagccggatgacgaagcagggcgtggtggtgccggcgcccgcggaggcggccgtcgcggtgccgcccagctcggcgccgctcctcccgtacccgccgccgcgggccgccatgcgcaagaagtgcctgcagatgggacctggcgtcggcggctgggtcgagtccatgcgcgcctcctcgcccacgcacgccagggccgccgccgcgctcgccgccggcgccgacgaggaccgccgcgccgcctggatggtggagcacccgtcggcgctgagcaagttcgaccaggtggtggcggcgtccaagggcaagcagatcgtcgtcttcctcgactacgacggcacgctctcgcccatcgtcgacgaccccgacgccgcctacatgtccgacacgatgcggcgggcggtgcgcagcgtcgccaagcacttccccacggcgatcgtcagcggccggtgccgcgacaaggtgttcgagttcgtgaagctggcggagctctactacgccggcagccacggcatggacatcaagggccccgccaaaggttcccggcacaccagggccgccaagggcgtcctcttccagccggccagccagttcctgcccatgatcgagcaggtgcacgagtctctggtggagaagaccaggagcatccctggagccaaggtggagaacaacaagttctgcgtctctgtccacttcagatgcgtcgatgagaagagctggagcgcgttggcggagacggtgaagtcggtgctcaaggagtacccgaagctgaagctgacgcaggggcggatggtgttcgaggtgcggcccatcatcaagtgggacaagggcaaggccctcgagttcctgctcgagtcgctgggcttcgccgactgcgccgacgtgctccccgtctacatcggcgacgaccgcaccgacgaggacgccttcaaggtgctccgccgccgcggccagagcgtcggcatcctcgtctccaagcaccccaaggacacctccgcgtcctactcgctgcaggagcccgccgaggtgatggagttcctgctgcggctcgtcgagtgggagcgcctctccaaggcccgccccaagtggtgaccggccggccgccgccgccgctgccgccggtcgcgaggagatcgattaccagacggattagcagtatatatattatatgtatcatatatattatctttacatcttcgatcatcagggggggttaaattagaagggagcgcgtatcctggcgtgtcagcggcgcgccgctcagctccccgcgtgtggtgtcgtacgttaaccctgccgagctcaccgcgccatgtgcgtccgcgacggggggccctcccccttctttttacgggggagggcgcgccctggggttgccggggggtagaagaaggcctcggaagcttgagctttccggagccccctggcttgctagagacgatgccatctggctgctgcgcagcaaggcaaaaaaaaaaagaacaaaaaaaaacaagaagaagaagaacgtgttgctgctttagtttgtgtaattagtgctgctattattactgtggccgcctgaattctgattgtgtaaaagatgtatgaaatggagatccagctacgggaatatatatatactag

SEQ ID NO: 1166 - protein, 360 aa, Panicum virgatum
  misc_feature: Ceres CLONE ID no.1791336
  misc_feature: Bit score of 661.1 for HMM based on sequences of FIGURE 9.
  misc_feature (105)..(338): Pfam Name: Trehalose_PPase Pfam Description: Trehalose-phosphatase
  misc_feature: Functional Homolog Of Ceres SEEDLINE ID no. ME20095 at SEQ ID NO. 1129
MTKQGVVVPAPAEAAVAVPPSSAPLLPYPPPRAAMRKKCLQMGPGVGGWVESMRASSPTHARAAAALAAGADEDRRAAWMVEHPSALSKFDQVVAASKGKQIVVFLDYDGTLSPIVDDPDAAYMSDTMRRAVRSVAKHFPTAIVSGRCRDKVFEFVKLAELYYAGSHGMDIKGPAKGSRHTRAAKGVLFQPASQFLPMIEQVHESLVEKTRSIPGAKVENNKFCVSVHFRCVDEKSWSALAETVKSVLKEYPKLKLTQGRMVFEVRPIIKWDKGKALEFLLESLGFADCADVLPVYIGDDRTDEDAFKVLRRRGQSVGILVSKHPKDTSASYSLQEPAEVMEFLLRLVEWERLSKARPKW

SEQ ID NO: 1167 - DNA, 1844 bp, Panicum virgatum
  misc_feature: Ceres CLONE ID no.1877752
  misc_feature: Encodes the peptide sequence at SEQ ID NO 1168
atccacccacctcaagctctcacaactcacaggtcagaagcaaagcccgcacgctcccccaagtcctgaggcaagctagctagctgtgctcctcccgtccgagtgcctggggttgggggaaggaaggtgaggcctcgccgtcttcgcggcgcacgagcctgcacctgggccgttggtgaggcgaagcacatgacgaaccaggacgtggtcgtgtcggagatgggcattgcggccggggcggcgctgccgggaccgagcccggcgctcttggcttgccggggcgcggccgccggcgccatgtcccttcggtacctcgacctggccgcggccgccgcgcgctcggccagctgcacctgggccgacgccatgcgcgcctcgtcccccacccgctcccgcgccgccgccgatgtcgacgagttcacggcctggatgaggaagcacccgtcggcgctcggcaagttcgaccagattgccagcgcgtccaaggggaagaagatcgtcatgttcctggactacgacggcacgctctcccccatcgtcgccgaccccgacgaggcctacatgagcgacgcgatgagggcggcggtgcgcgacgtcgcgaagcacttcccgacggcgatcgtgagcgggcgctgccgcgacaaggtgcgcaacttcgtcggcctctcggagctctactacgccggcagccatggcatggacatcaagggaccaagatccaatccggagtcggtcctgtgccaacctgcaagcgagttcctcccagtgatcgacgaggtgtacaaggcgctggtggaaaagacgaagtccacacctggagccaaggtggagaacaacaagttctgcctgtccgtgcacttcagatgtgtagatgaaaagagatggaatgctttggcggagcaagtcaaggccgtcatcaaggactaccccaagctgaagctcactcaagggaggaaggttctggagatccgcccgagcatcatgtgggacaagggcaaggccttggagtttctgctcgaatcgctcggattcgccagctgcagcgacgtcctcccggtgtacatcggtgacgaccgcaccgacgaggatgctttcaaggtgctgaggaagaggggtcagggcatcggcatcctcgtctccaagtgccccaaggagaccaacgcctcctactccctgcaggacccgagcgaggtcatggacttcttgctccggctggtggagtggaagcgcaagtcgccgccgccgccgatgatccggccgcgagtgtagctggctggctcggcgcggcagccggtcggcggccggtcgactagtgaatcgacggactgatcgaatcggtgtccaatcatgcgaacataccccaccaccaatgttccccctctctgacgattcttagcttgtgtggtggcctccgaaacggactcgtggtggttgctgcgttgcacgcatgttcttcgattccctggcggggccacacacacacaacacaactcctccgcgtcactgaaaatgttggagcatgttggtgctgctgtctaatacagtaaccgtgtgtctgcttccccggcaatgtaccactagtagtacccctcccttctcgtgttatttttgtccctcgtctcatccccatgggcttggaaggcatctgcaaagctccctgccgtcctagaagagaagaacctttgcaagaaagagaaggttcccttcaccccatgtaactagcacctactatattctaggcactactgttctttgtacccttctctgctgtgtaaaatgtagtctgtaaaagtaattaagatccaagtaatggaattattttgtaaaaaaaaaaaaaaaaaaaa

SEQ ID NO: 1168 - protein, 359 aa, Panicum virgatum
  misc_feature: Ceres CLONE ID no.1877752
  misc_feature: Bit score of 632.7 for HMM based on sequences of FIGURE 9.
  misc_feature (106)..(333): Pfam Name: Trehalose_PPase Pfam Description: Trehalose-phosphatase
  misc_feature: Functional Homolog Of Ceres SEEDLINE ID no. ME20095 at SEQ ID NO. 1129
MTNQDVVVSEMGIAAGAALPGPSPALLACRGAAAGAMSLRYLDLAAAAARSASCTWADAMRASSPTRSRAAADVDEFTAWMRKHPSALGKFDQIASASKGKKIVMFLDYDGTLSPIVADPDEAYMSDAMRAAVRDVAKHFPTAIVSGRCRDKVRNFVGLSELYYAGSHGMDIKGPRSNPESVLCQPASEFLPVIDEVYKALVEKTKSTPGAKVENNKFCLSVHFRCVDEKRWNALAEQVKAVIKDYPKLKLTQGRKVLEIRPSIMWDKGKALEFLLESLGFASCSDVLPVYIGDDRTDEDAFKVLRKRGQGIGILVSKCPKETNASYSLQDPSEVMDFLLRLVEWKRKSPPPPMIRPRV

SEQ ID NO: 1169 - DNA, 1511 bp, Panicum virgatum
  misc_feature: Ceres CLONE ID no.1821191
  misc_feature: Encodes the peptide sequence at SEQ ID NO 1170
acaccaatcatcgccggcctcgattctctccggtcactgcctggtcagggttcttgtttccttgcgtagatcgatcacgatcaggacgtgagttccgagcgatggcgaagccgagcgtgggcgtctcggaagtgggggtctcggcggcggcggcgcaggcggcgtgcccctgccccgggacgctgttcccgtacccgccgccgcgcggcgccgggatcgccgcctccgtgcggcgcaagtgcctgcaggtggagctcggcggcggggcggcggggctgctgggcggcgcctggggcgtcgagtcgatgcgcgcgtcgtcgcccacgcacgccaaggccgtggcggccctcgccggcggcgtggacgacgagcgcgcggcgtggatggtgcggcacccgtcggcgctgggcaagttcgagcagatcgtggcggcgtccgagggcaagcgcatcgtgatgttcctggactacgacggcaccctgtcgcccatcgtggacgaccccgacgccgccttcatgagcgagacgatgaggatggccgtgcgcagcgtcgccragcacttcccgacggcgatcgtgagcggccggtgccgcgacaaggtgttcgagttcgtgaagctggcggagctctactacgcggggagccacggcatggacatcaagggcccggccaaggcctcttcccggcacgcaaaggccaaggcgaagggcggaggagtcctgttccaaccggcgagcgagttcctgccgatgatccaggaggtgcacgagcgcctggccgagacgacgcgctgcatcccgggggccaaggtggagaacaacaagttctgcgtctccgtccacttcagatgcgtcgacgaaaagatgtggggcgagctgtcggaggcggtgaagggcgtgctgcgggggtacccgaggctgcggctgacgcaggggcggatggtgctggaggtgcggcccaccatgaagtgggacaagggccgggcgctcgagtttctgctcgagtcgctgggcttcgccgactgcgccaacgtcctgcccgtctacatcggcgacgaccgcaccgacgaggacgccttcaaggccctgcggcggcgggggcagggcgtgggcatcctcgtctccaagcaccccaaggagacgaccgccaactactcgctccgggagcccgccgaggtcatggagttcctgctgcgcctcgtcgagtggaagcgactctccaggaccagcctcaggctcaggctgcaatgacgacgactcttcttgcactataccctgcaggacgtacaatgcggcgcggatcgatgcaactcaaagctgattaattgcgtgattggaattggatctaacactgattgttgcacttgtaccatctcgatctcgtggagtgcgagagctctgttttcctctccattcttcttttttccccagggccggaacgggtgtatgtacattctgtagttgatgatattatacctacaagaggaattatacgtgtcccgttaccattcc

SEQ ID NO: 1170 - protein, 382 aa, Panicum virgatum
  misc_feature: Ceres CLONE ID no.1821191
  misc_feature: Bit score of 642.5 for HMM based on sequences of FIGURE 9.
  misc_feature (120)..(357): Pfam Name: Trehalose_PPase Pfam Description: Trehalose-phosphatase
  misc_feature: Functional Homolog Of Ceres SEEDLINE ID no. ME20095 at SEQ ID NO. 1129
  misc_feature (152)..(152): Xaa is any aa, unknown, or other
MAKPSVGVSEVGVSAAAAQAACPCPGTLFPYPPPRGAGIAASVRRKCLQVELGGGAAGLLGGAWGVESMRASSPTHAKAVAALAGGVDDERAAWMVRHPSALGKFEQIVAASEGKRIVMFLDYDGTLSPIVDDPDAAFMSETMRMAVRSVAXHFPTAIVSGRCRDKVFEFVKLAELYYAGSHGMDIKGPAKASSRHAKAKAKGGGVLFQPASEFLPMIQEVHERLAETTRCIPGAKVENNKFCVSVHFRCVDEKMWGELSEAVKGVLRGYPRLRLTQGRMVLEVRPTMKWDKGRALEFLLESLGFADCANVLPVYIGDDRTDEDAFKALRRRGQGVGILVSKHPKETTANYSLREPAEVMEFLLRLVEWKRLSRTSLRLRLQ

SEQ ID NO: 1171 - DNA, 1883 bp, Zea mays
  misc_feature: Ceres CLONE ID no.446838
  misc_feature: Encodes the peptide sequence at SEQ ID NO 1172
ctcctttctctcccagctcccaaaattccctctccgtcgccgccgctcccaaaatcccctctccgtcgccgcctctcgccaggtcgtttccaagccccgttgggggcctcgccggcgccggcattggatataacctcgcccgctacctccgtccgaatgcagggccttgatatttaatgggctggaggtggtacatgcatgttcgcagtgacaagaacacattgaaacgttggtttttcattgacaagaggcttgttaaagcatttttggtgcactaaccttttgttgtctgtaattggtttcacaacaagtttcttggggggttgtgtcctgttgatggatttgaagacaggcctcaattcacctgttattgctgaccatctccctacgttagcattgcctgctgctgtcatgactttcacaacacctactagctttccctctccggggctttgcttgaacactacaaagaagatacctctgcctggtaagattgaagaagttcgtgctgctggatggcttgatctcatgaaggcctcatcacctacccgcaaaaggcagatcaaggatgtcatctgtgatgctcaatctgatcttgatttgcaatactgcaactggacagtgaactatccttctgctttgatctcatttgaggcaattagtgatcttgctgggagtaaaaggttggcattgtttcttgactatgacggaacactttcaccgattgtggacaatcctgaaaatgcattaatgtctgatgagatgcgtgctgcagtgaggcatgcggcatcacttttcccaactgcaatcattagcggaagatctcgtgataaggtttttgactttgtgaagctaaatgaattgtactacgctggaagccatggaatggacataatgggccctgttaggaagactactgactccaatggcgtggaatgtattcggtcaactgatgtgcatggtaaagaagtcaacctgttccaacctgctagtgagtttttacctatgatcactgaggtgtatgaaaaacttggtgagagtgttaaggacattgatggtgcaaggatggaagacaacaagttctgtgtatctgtgcattaccgtaatgtggcggaagatgactataaaaaggttttccatcgtgtaactgctgttttggaaggttacccttgcctaagactaacccatgggaggaaggtttttgaggtccgtcctgttattgattggaacaaaggtaaagctgtggagtttttacttgaatcgcttgggctcagcgagagtgaagatgttctccctatctatgttggagatgacagaacagatgaagatgcattcaaagttctgaaggcaagcaaccgtggctttggaatattggtgtcgtctatacccaaagagagtgacgccttctactccttgagggatccagctgaggtgatggaatttctgagaatgttggcagcatggaaggagcagtccacctgatatcagttttgctgggtctgagaatgtgggcagtccacaagattataaatattagcaagatatataatatataatgctaatcaaataaatcggctattaggaggactcgagccatttttttgatttggcattttataagaggctaccacatttccatactttttcagtcccactttgttcttgtgttaaatgggttttcaaacagttcaattctttcattatttaggttccttaagtatatatgcaaatattcttaaaagggattttttggttccttctagtgtttcactgtgttgcgatttttgtattctgcaatctgtaaagaaccggttcttcgtataaacagcatttgacaatgcctcatggaaagtcaagttatgagcaaaaaaaaaaaaaaaaaa

SEQ ID NO: 1172 - protein, 381 aa, Zea mays
  misc_feature: Ceres CLONE ID no.446838
  misc_feature: Bit score of 804.8 for HMM based on sequences of FIGURE 9.
  misc_feature (120)..(364): Pfam Name: Trehalose_PPase Pfam Description: Trehalose-phosphatase
  misc_feature: Functional Homolog Of Ceres SEEDLINE ID no. ME20095 at SEQ ID NO. 1129
MDLKTGLNSPVIADHLPTLALPAAVMTFTTPTSFPSPGLCLNTTKKIPLPGKIEEVRAAGWLDLMKASSPTRKRQIKDVICDAQSDLDLQYCNWTVNYPSALISFEAISDLAGSKRLALFLDYDGTLSPIVDNPENALMSDEMRAAVRHAASLFPTAIISGRSRDKVFDFVKLNELYYAGSHGMDIMGPVRKTTDSNGVECIRSTDVHGKEVNLFQPASEFLPMITEVYEKLGESVKDIDGARMEDNKFCVSVHYRNVAEDDYKKVFHRVTAVLEGYPCLRLTHGRKVFEVRPVIDWNKGKAVEFLLESLGLSESEDVLPIYVGDDRTDEDAFKVLKASNRGFGILVSSIPKESDAFYSLRDPAEVMEFLRMLAAWKEQST

SEQ ID NO: 1173 - DNA, 1811 bp, Zea mays
  misc_feature: Ceres CLONE ID no.1556915
  misc_feature: Encodes the peptide sequence at SEQ ID NO 1174
aaccctcctcctcctgttctcctcgcaccttctcccacctctgctctgccctgctctgctctcccaggctaggtcctgcagctgcaagcaccgaggacagacagagtcgctcgcttcgccaccactagctgttgcttgcctgccacccaaggctttccttccatcgagatcaagtagcgtagcggcttgcctgaccaagaggcagagctctcgatgacgaagcagggcatggtggtgccggtgcctgaggcggccgtggcggtaccgcccaactcggcgccgctgttccagtacccgccgccgcgggccgcgccgggcgtcgccgtgcgcaagaagtgcctgcagatgggcgccggcgtcggcgtcggcgccggcgccgggcgcatcggcggctgggtggagtccatgcgcgcgtcctcgcccacccacgccaaggcggccgccgcgctcgccgcgggcgtcgaagaggagcggtacgccgcgtggatggtgaagcacccgtcggcgctggccatgttcgaccagctggtggaggcgtccaaggggaagcagatcgtcgtgttcctcgactacgacggcacgctgtcccccatcgtcgacgaccccgacgccgcctacatgtccgacacgatgcggcgggcggtgcggagcgtcgccaagcacttcccgacggcgatcgtgagcgggcggtgccgcgacaaggtgttcgaattcgtgaagctggcggagctgtactacgccggcagccacggcatggacatcaagggccccgccaaagggtcccggcacaccaaggccaaaggcggcgttctctttcagccggccagccagttcctgcccatgatagagcaggtgcacgattctctggtggaaaagaccaagtgcatacctggagccaaggtggagaacaacaagttctgtgtgtctgtccacttcagatgcgtcgatgagaagagctggatcacgttggcggatatggtgaagtcggtgctcaaggactacccgaagctgaagctgacgcagggcaggatggtgttcgaggtccgccccaccatcaagtgggacaagggcaaggccctggagttcctcctcgagtccctcgggtacgccgactgcaccgacgtgctgcccgtgtacatcggcgacgaccgcaccgacgaggacgccttcaaggtgctccgcaagcgcgggcagggcgtgggcatcctcgtgtccaagcaccccaaggacacctgcgcctcctactcgctgcaggagcccgccgaggtgatggagttcctgctgcggcttgtcgagtgggagcgcctctccaaggcccgcccaaagtggtgatccaatccacgatgacagatgacgttcgagctgggattaattatacactaaatatgctcaatatataagttagttatactaagggtgatggattaattagagggatcgggggagcgagggagtaattaagaccgtacgcacccactcctacttgagctgagctgagctgagctgagacgacgagacgagagctcgctgcgctgtgcacggcacagtcatgtgcgtccagtccacggcgcctccctatgtttttacgggagccatgtggcggctgctgcgcggcaagggtgaagaatgtacgagctgctgtagcactccagtaattacttcctactcttactccagccatgaaccttggctctggatcctgaattctgattgtgtacaagtacaagagagcaactgctgtcgatgctatgtatgaaatcatctctataaattaagtagccagctttcctctgcaaaaaaaaaaaaaaaaa

SEQ ID NO: 1174 - protein, 372 aa, Zea mays
  misc_feature: Ceres CLONE ID no.1556915
  misc_feature: Bit score of 670.7 for HMM based on sequences of FIGURE 9.
  misc_feature (117)..(350): Pfam Name: Trehalose_PPase Pfam Description: Trehalose-phosphatase
  misc_feature: Functional Homolog Of Ceres SEEDLINE ID no. ME20095 at SEQ ID NO. 1129
MTKQGMVVPVPEAAVAVPPNSAPLFQYPPPRAAPGVAVRKKCLQMGAGVGVGAGAGRIGGWVESMRASSPTHAKAAAALAAGVEEERYAAWMVKHPSALAMFDQLVEASKGKQIVVFLDYDGTLSPIVDDPDAAYMSDTMRRAVRSVAKHFPTAIVSGRCRDKVFEFVKLAELYYAGSHGMDIKGPAKGSRHTKAKGGVLFQPASQFLPMIEQVHDSLVEKTKCIPGAKVENNKFCVSVHFRCVDEKSWITLADMVKSVLKDYPKLKLTQGRMVFEVRPTIKWDKGKALEFLLESLGYADCTDVLPVYIGDDRTDEDAFKVLRKRGQGVGILVSKHPKDTCASYSLQEPAEVMEFLLRLVEWERLSKARPKW

SEQ ID NO: 1175 - protein, 355 aa, Zea mays
  misc_feature: Public GI ID no.90200725
  misc_feature: Bit score of 547.3 for HMM based on sequences of FIGURE 9.
  misc_feature (101)..(335): Pfam Name: Trehalose_PPase Pfam Description: Trehalose-phosphatase
  misc_feature: Functional Homolog Of Ceres SEEDLINE ID no. ME20095 at SEQ ID NO. 1129
MTKRTAFAADDAIIAAAAAVTSQPGRRFTSYPPARARGGCRLAPAAAARQATDDPGAAGSWPELVVPRHADFDDWMEKHPSALAAFESVLAAAKGKKIVMFLDYDGTLSPIVRDPDSAVMSEEMRDAVRGVAEHFPTAIVSGRCRDKVFNFVKLAELYYAGSHGMDIKGPTAQSKHTKAKAGAVLCQPARAFLPVIEEVYRALTASTAPIPGATVENNKFCLSVHFRCVQEEKWRALEEQVRSVLKEYPDLRLTKGRKVLEIRPSIKWDKGNALQFLLESLGFAGSNSVFPIYIGDDSTDEDAFKVLRNLGQGIGILVSKIPKETRASYSLREPSEVEEFLRKLVSWSKESRQRD

SEQ ID NO: 1176 - DNA, 2404 bp, Zea mays
  misc_feature: Ceres CLONE ID no.1580247
  misc_feature: Encodes the peptide sequence at SEQ ID NO 1177
accaccgcaggcaaagcttcgggcaacaacagcttgctcgactcagcgcccatctatctctcttctcccccgcctgtctagccagcggcgaccaccaccaccgttcagttattatagcaagcatgacgaagcacggcgtggtgatcggcccggaggacgtcgcggcggcgcggcatttctcgttcccgccgccgaggacggcggcgggcggcgagtcgtgcaggaagctggcggcgcaggtggacctcggccccgccgtcgtggggtcctggctcgactccatgaaggcctcgtcgcccaggcacaggctcatggcgcccgtgcccggcgccgccgacgcggagcacgacgactggatggagcggcacccgtcggcattggaccgcttcgacgcgctggcggcggcggccaaggggaagcaggtcgcggtgttcctggactacgacggcacgctgtccccgatcgtggaggaccccgaccgcgccgtcatgacggacgagatgagggacgcggtgcgcggcgtggcggcgcgcttcccgacagcgatcgtcagcgggcggtgccgggacaaggtgttcagcttcgtgcggctagcggagctctactacgccgggagccacgggatggacatccgggggcccaccgccgacgccaaccaccaccacggcaacggcaaggcggaggcggaggcggaggcggtgctctgccagccggcgagcgagttcctgccggtgatgcaggaggtgtacgcggcgctggtggccaaggtggagcgcgccatcccgggcgccaaggtggaggacaacaagttctgcctgtcggtccacttccgttgcgtggaggaggcgtgctgggccgcgctcttcgagcaggtccgcgccgtgctgagggaccacccgggcctgcgcctcacccagggccgcaaggtgctggaggtccgccccatgatccgctgggacaagggcaaggcgctggagttcctgctccacgccctcggcttcgccgccgacgccgaccgcgacgacgtcttccccatctacgtcggcgacgaccgcaccgacgaggacgccttcagggtgctgcgcgcgcgcgggcacggcgccgggatcctcgtgtccaggttccccaaggacaccagcgtccttcacgctacgcgaccccgccgaggtcaaggagttcctgcgcaagctcgtcggcgccaacgacgacagctgatgatccggcccgcgattcgtttccctttcccgccgtgaccagctccgatccgcctgtgtcaagccgctaactcaacctcggctacctacctgctgcaccggcagagggcttccttgttgttgcaactgcatctccatcgagcagcttgctttgggacaagaacagacctagctagtagtacagtagagcccttttgtatcttcgttttttttttggtttccatctctcttgttcatcatgcatgcctgctgttgtttaccatttgcctcggctgaaaaggcttgtattttcggcgcccttcccgcgaggcactgtaactagttgctttgtctgctgtacgtacgcgtaccatgttgaaataatagcccgccgaaagcgtcgtcgggccacctcgcactcgcgcgcgcctcaaagatgcacaggcagctcagcctctccgccagcccgaagcagcagcagccgcctcctgacggcaccagcaccggcggcggcgacgcggcggcgaaggcgatggcggcggcggaggacgagtcgtcggcctcgcactccagctccaaggccagcagggggtggtcggcgagggacgagagggccatccacctcgtcccgctgctcaccttcctctgcttcctcctgctcttcctctgctcccacgacccgtcccccgccgatatgtcgagcttcgctggaggcggctgcggaggaggaggagcgagatctgggaaccggaggttaaggatgctttagtgtgcgtattacctacccattggagtattattatccgcgatgcggatgttgtacttgtccagcagtaaccaagtatgggaccaaagtatgtcaccatacaaaacactcttgctgtggtaatactaccaacctacatcagcatgttcctgattaccatttgagctggattcgaaatacctggcacgtccaacaggcagcagtacatggcaatggcattccaaaggcgtggtgatcggcccggaagacgtcgcggcggcgcggaatttctcgttaaaaacaacgaagacggcggcgggcggcgagtcctgcccgagatggggggtcacaagaagacctcggccccgccgtcgtggggtcctggctcgactccatgaaggcctcgtcacccaggcacaggctcatggcgcccgtgcccggcgccgccgacgcggagcacgacgac

SEQ ID NO: 1177 - protein, 376 aa, Zea mays
  misc_feature: Ceres CLONE ID no.1580247
  misc_feature: Bit score of 509.3 for HMM based on sequences of FIGURE 9.
  misc_feature (104)..(339): Pfam Name: Trehalose_PPase Pfam Description: Trehalose-phosphatase
  misc_feature: Functional Homolog Of Ceres SEEDLINE ID no. ME20095 at SEQ ID NO. 1129
MTKHGVVIGPEDVAAARHFSFPPPRTAAGGESCRKLAAQVDLGPAVVGSWLDSMKASSPRHRLMAPVPGAADAEHDDWMERHPSALDRFDALAAAAKGKQVAVFLDYDGTLSPIVEDPDRAVMTDEMRDAVRGVAARFPTAIVSGRCRDKVFSFVRLAELYYAGSHGMDIRGPTADANHHHGNGKAEAEAEAVLCQPASEFLPVMQEVYAALVAKVERAIPGAKVEDNKFCLSVHFRCVEEACWAALFEQVRAVLRDHPGLRLTQGRKVLEVRPMIRWDKGKALEFLLHALGFAADADRDDVFPIYVGDDRTDEDAFRVLRARGHGAGILVSRFPKDTSVLHATRPRRGQGVPAQARRRQRRQLMIRPAIRFPFPP

SEQ ID NO: 1178 - DNA, 1510 bp, Glycine max
  misc_feature: Ceres CLONE ID no.644201
  misc_feature: Encodes the peptide sequence at SEQ ID NO 1179
catatcatactctcttctcttctcttcactttgatttcattgcaattacctctttttgttgtgatcttcttcccttctctgttctaaaaaagaacacggctgatctgggctcgactaaaacaaatcactaagtaaaaatgacgcagaatgcgatagtgtccaagacaaaatcggggatcaaccgggacataaccgtgccacaaaagccactggcggcggcggcggcggcgggggggtacattcccattccgaggaggagggttttgaagaacctggaaatcaatgcatgggttgattccatgagatcctcttctccaaccaattccaaatccacctcttctctcgcagaagaacacagcacttggattcttcgccacccctcagcattagacatgttcgagcaaattatggatgcgtcccggggaaagcaaattgtcatgtttctcgactatgatggtactttgtcgcctattgttgatgacccagaccgtgctttcatgtcggattcgatgaggagaacggtgaggaaacttgcaaggtgttttcctactgctatagttaccggcagatgcaaagacaaggtttacaattttgttcgcttggctgagctatattatgctggaagccatggcatggatattcaagggccaacaagaacctccaaatacagcaacaaagataaaggagagcctgttctttttcaacctgctagtgaatttcttcccatgattgatgaggtgtaccatcaattagttgagaaaatgaaatcaattcctggagccatggtggagaacaacaagttctgctgttctgttcattttcgctgcgttgatgaaaagaaatggagtgaactggcacaggaagtgagatcagtattaaaagagtacccgaagcttcgtcttaaccaaggaaggaaggtattagagattcgtccatctattaaatgggacaaagggaaggcgctggaatttttgttagagtcacttggatttgccaactgtaacgatgtctttcctgtttacattggagatgataaaaccgatgaagatgcattcaagaaattaagagacagaggacaaggttttgggattcttgtctcgaaatttccaaaggacactactgcatcatactctttacaagaaccaaacgaggtgatggatttccttcaacgtttggtggagtggaaacaagtatccctccgactcagaacacgttctcgggtgtaaatggatagaatgataatgtacatccctaccctgccataaaaaatggagttcagctagggtagcatataggacccttttttctatgttttgttcagattagaacagagaacaaaaatgtatggaaaaaggaaagacaaaagtgtctttctgagtttgaagcacgtctacatggatgtaattagccacgtagtttttgtagtacaggggaaacgtctctgttgcatcaaatgtaattctgaatggaaaataacatgttacgtatcgaaaaatatatattattgtat

SEQ ID NO: 1179 - protein, 362 aa, Glycine max
  misc_feature: Ceres CLONE ID no.644201
  misc_feature: Bit score of 684.3 for HMM based on sequences of FIGURE 9.
  misc_feature (102)..(337): Pfam Name: Trehalose_PPase Pfam Description: Trehalose-phosphatase
  misc_feature: Functional Homolog Of Ceres SEEDLINE ID no. ME20095 at SEQ ID NO. 1129
MTQNAIVSKTKSGINRDITVPQKPLAAAAAAGGYIPIPRRRVLKNLEINAWVDSMRSSSPTNSKSTSSLAEEHSTWILRHPSALDMFEQIMDASRGKQIVMFLDYDGTLSPIVDDPDRAFMSDSMRRTVRKLARCFPTAIVTGRCKDKVYNFVRLAELYYAGSHGMDIQGPTRTSKYSNKDKGEPVLFQPASEFLPMIDEVYHQLVEKMKSIPGAMVENNKFCCSVHFRCVDEKKWSELAQEVRSVLKEYPKLRLNQGRKVLEIRPSIKWDKGKALEFLLESLGFANCNDVFPVYIGDDKTDEDAFKKLRDRGQGFGILVSKFPKDTTASYSLQEPNEVMDFLQRLVEWKQVSLRLRTRSRV

SEQ ID NO: 1180 - DNA, 1579 bp, Glycine max
  misc_feature: Ceres CLONE ID no.538689
  misc_feature: Encodes the peptide sequence at SEQ ID NO 1181
tcacacatacaatacaacacaatacactctccatttctcactccttttcttctcttcactcttcatttcctctcattaatctctttctttgatccatattctgccataacagcacacgataactaaaccacaacaacacttgaagttagttacttgtactttctctgaaactttgattgtgtcaaaatgacgcagcagaatgtggtagtgtctgatactaaatcaggagtttccttaacggttttctcaacaacacaaaagccaccggcggcgccaggagggtacatttccattccaaggaggagggttttgaagaaccttgaaatcaatggaggccaaagaatcaatgcatgggttgagtccatgagagcctcctctccaacccatcataaatccacaccttctttgtctcaggagcataactcttggattcttcaccatccatcagcattagacatgtttgaccaaatcattgacgcgtcaaagggaaaacaaattgtcatgtttctggactatgatggcacgctgtctcctatagttgacgaccctgaccgtgctttcatgtctgattcgatgagaaaaacagtgaggaaacttgctaggtgtttccctactgctatagtgaccggcagatgcaaagacaaggtgtacaattttgttcgcttggcagagctatattatgcaggaagccatggcatggatattaaaggaccaacaagaagctccaaatacaacaaagatagcaaagctgaggcaatcctttgtcaacctgccagtgattttcttcccatgatagatgaggtgtatcaacaattagttgaaaagacaaaatcaactcctggagctctggttgagaacaacaagttctgtctttctgttcattttcgttgtgttgatgaaaagaaatggagtgaactggcacgccaagtgaaatcagttttaaaggagtacccgaaacttcgacttacccaaggaagaaaggtgctagagattcgtcccactattaaatgggacaaagggaaagccttggaatttttattagagtcacttggtttggccaactgtagtgatgtctttcctgtttatattggcgatgatcgatccgatgaagatgctttcaagaaattaagagacaaaggacaaggttttggcattcttgtctccaaatttccgaaagacacaagcgcatcttactctttgcaagaacccaatgaggtgatgaactttcttcaacgcttggtggagtggaaacatgtgtccctgcgagcacgttcctgagtgtaaatgagaaagatgaaatgacatgtacatccctaccctgccatgaaaaagaagttcagcttgggtagaatataggatgttttgtattttttgttcagtcagaacaaaagtgtatggaaatagaaagacaaaagtgtctttcttagtttgaaagacgtccacattcatgtaattagccaagtattactcagtacatgggaaaaaagtttatgtagccttcagatgcaagtctgaatggattaaaatttcgcttccttgttacatggatcaaactatgattaagtaagtatggtttctc

SEQ ID NO: 1181 - protein, 363 aa, Glycine max
  misc_feature: Ceres CLONE ID no.538689
  misc_feature: Bit score of 682.8 for HMM based on sequences of FIGURE 9.
  misc_feature (107)..(342): Pfam Name: Trehalose_PPase Pfam Description: Trehalose-phosphatase
  misc_feature: Functional Homolog Of Ceres SEEDLINE ID no. ME20095 at SEQ ID NO. 1129
MTQQNVVVSDTKSGVSLTVFSTTQKPPAAPGGYISIPRRRVLKNLEINGGQRINAWVESMRASSPTHHKSTPSLSQEHNSWILHHPSALDMFDQIIDASKGKQIVMFLDYDGTLSPIVDDPDRAFMSDSMRKTVRKLARCFPTAIVTGRCKDKVYNFVRLAELYYAGSHGMDIKGPTRSSKYNKDSKAEAILCQPASDFLPMIDEVYQQLVEKTKSTPGALVENNKFCLSVHFRCVDEKKWSELARQVKSVLKEYPKLRLTQGRKVLEIRPTIKWDKGKALEFLLESLGLANCSDVFPVYIGDDRSDEDAFKKLRDKGQGFGILVSKFPKDTSASYSLQEPNEVMNFLQRLVEWKHVSLRARS

SEQ ID NO: 1182 - protein, 384 aa, Nicotiana tabacum
  misc_feature: Public GI ID no.51458330
  misc_feature: Bit score of 983.6 for HMM based on sequences of FIGURE 9.
  misc_feature (122)..(364): Pfam Name: Trehalose_PPase Pfam Description: Trehalose-phosphatase
  misc_feature: Functional Homolog Of Ceres SEEDLINE ID no. ME20095 at SEQ ID NO. 1129
MDLKSNTSPVVTDPAPMTQSRLGTHSALMPYSPTGATFSPTLFLTIPRKKPGILDDVRSNTWLDAMKSSSPTHSKKNKDSNAELTANESDLAYRIWMLKYPSALSSFEQITNYAKGKRIALFLDYDGTLSPIVDDPDRAFMSGAMRATVRNVAKYFPTAIISGRSRDKVYDFVGLAELYYAGSHGMDIMGPVRSVSDDYSCIRSTNKQGKEVNLFQPAGEFLPMIDEVFRSLIELTKDITGAKVENNKFCVSVHYRNVDEKSWSAIGESVDELLKHYPRLRLTHGRKVLEVRPVLNWDKGKAVEFLLESLGLKNCDDVLPIYVGDDRTDEDAFKVLREGNKGYGILVSSAPKESSAFYSLRDPSEVMEFLKCLVSWKKSSGFSY

SEQ ID NO: 1183 - DNA, 376 bp, Triticum aestivum
  misc_feature: Ceres CLONE ID no.817225
  misc_feature: Encodes the peptide sequence at SEQ ID NO 1184
aacaccaatcatttcctcttcactgtctcttctccttttctgccttccaaccaaagccccatcccttgattcgatcgatcgggatcctcctctcgcgcgcttctaggacctgcccctcgaagcttctccttctccttggacccgtgcttggtatggcgcagacgactgtggtggtgccggaggtgggcatgacggctgccacgcccactgcgtgcccctsccctgggtcgctgttcccgtacccgccgccgcgtgccgggatggccgtgagccgcaagtgcctgcgggcgscgcagscggagcttggcgcggggatgctcagtggcctggtcgagtccatgcgggcgtcctcccccacgcacgccagggccgccgc

SEQ ID NO: 1184 - protein, 373 aa, Triticum aestivum
  misc_feature: Ceres CLONE ID no.817225
  misc_feature: Bit score of 646.3 for HMM based on sequences of FIGURE 9.
  misc_feature (114)..(345): Pfam Name: Trehalose_PPase Pfam Description: Trehalose-phosphatase
  misc_feature: Functional Homolog Of Ceres SEEDLINE ID no. ME20095 at SEQ ID NO. 1129
MAQTTVVVPEVGMTAAAPTACSCPGSLFPYPPPRAGMAVSRKCLRAAQAELGAGMLSGLVESMRASSPTHARAAAALSAGVDDEHAAWMARHPSALGKFEEIVAASKGKQIVMFLDYDGTLSPIVDDPDAAFMSETMRMAVRSVAKHFPTAIVSGRCRDKVFDFVKLAELYYAGSHGMDIKGPAKSSKSKAKGVLFQPASEFLPMIEEVHQRLIEETKHVAGAKVENNKFCVSVHFRCVDEKSWGALAETVKGVMREYPKLRMSQGRMVFEVRPTIKWDKGKALEFLLESLGFADCPNVLPVYIGDDRTDEDAFKVLRRRGQGVGILVSKHPKDTSASFSLQEPAEVMEFLLRLVEWKQLSKARLRLRRQADA

SEQ ID NO: 1185 - DNA, 1917 bp, Triticum aestivum
  misc_feature: Ceres CLONE ID no.923842
  misc_feature: Encodes the peptide sequence at SEQ ID NO 1186
accttaagctctgagaagctaccacacacacacacacacgcaccgcgcacgaacgcacgcgcgcaccccctgaaggccagctgcttgtgcccgtgcgccgtctcgccggagcttggcgttggaacgagaccgggagcttgcgggcttcgcgtacgttacacgagctctcagctggttctccggccgggcttgcttgtttggccgtgcgcagcgcgccgagtgacatgacgacgagccaggacgtggttgtttcggagatgggcattgggccgggtggggcggccatgccgggctccggcgccgcgggcctcttcgcgtgccgcagcgccgccagcgccggagccatgtccatggggcagacgtaccgcgacctcgccgccgccgcctcgcgctccgcgaactgcacatgggccgagctcgaggccatgcgcgccgcctcgcccacccgctcccgccccggcaccgacgtcgacgagctcacggcctggatgaggaagcacccgtcggcgctaggcaagttcgatcaaatcgccagcgcgtccaaggggaagaagatcgtcatgttcctggactacgacggcaccctctcgcccatcgtcgccaaccccgacgccgcctacatgagcgacgcgatgagggaggcggtgcgcgacgttgccaagcacttcccgacggcgatcgtgagcgggcggtgccgcgacaaggtgcacaacttcgtcggcctctccgagctgtactacgccggcagccacggcgtggacatcaaggggccaggctccaatccggagtctgtgctgtgccaacctgcaagcgagttcctccccatgatcgatgaggtgtacaaggtgcttgtggaaaagacgaagtccacacctggagccaaggtggagaacaacaagttctgcctgtccgtccacttcagatgtgtggatgaaaagagatggaacttcttggctgagcaggtcaaggccgtgatcaaggactaccccatgctgaagctcacccaagggaggaaggtcttcgagctccggcccagcattatgtgggacaagggcaaggcgctggagttcttgcttgaatcgctaggattcgccagctgcagcgacgtcctgccggtgtacatcggcgacgaccgcaccgacgaggacgccttcaaggtgctgaggaagaggggccagggcgtggggatcctggtgtccaagtgcgccaaggagaccagcgcgtcctactcgctgcaggacccggcggaggtcatggagttcctgctccggctggtggactggaagcggaggtcgtcggcgccgcccatggtccggccgcgggtgtaaccccggccggcccaccagctatagcctagcacagatccaagacgccggtcgggtcgaccaccggtcaatccagctcgtcgcgatcggtgtcccgtcatgccaacactaccccacccccaccccaccccaccccgcccaagttttctctgatggttctctggtggcctccggagcagaccctgcggtggttacgtgcatgttcttcggtcgagcccccgtggaaaacgatcggaggcccacgcagctcgctcgctcgcttgctcccgaactgcacgccttgtgctgggggctgcagcagctacaatataacacagtgaccgaccgaccgtgtctacctaggcactactgctggtctactagtactctactgtactcccttgttgttttttgtcccacgggctcggaaggcacatgcaaagctacctgccgttcccagacccggccggccttgacgagaaagaaggttctccgtgttattcacccatgtaactagctaggatcgccctctgtccagcgttcaattgtcatctctgtaaaatgcagtaatggaatcagttaacagtgattatttccaaaaaaaaaaaaaaaa

SEQ ID NO: 1186 - protein, 367 aa, Triticum aestivum
  misc_feature: Ceres CLONE ID no.923842
  misc_feature: Bit score of 608.7 for HMM based on sequences of FIGURE 9.
  misc_feature (114)..(341): Pfam Name: Trehalose_PPase Pfam Description: Trehalose-phosphatase
  misc_feature: Functional Homolog Of Ceres SEEDLINE ID no. ME20095 at SEQ ID NO. 1129
MTTSQDVVVSEMGIGPGGAAMPGSGAAGLFACRSAASAGAMSMGQTYRDLAAAASRSANCTWAELEAMRAASPTRSRPGTDVDELTAWMRKHPSALGKFDQIASASKGKKIVMFLDYDGTLSPIVANPDAAYMSDAMREAVRDVAKHFPTAIVSGRCRDKVHNFVGLSELYYAGSHGVDIKGPGSNPESVLCQPASEFLPMIDEVYKVLVEKTKSTPGAKVENNKFCLSVHFRCVDEKRWNFLAEQVKAVIKDYPMLKLTQGRKVFELRPSIMWDKGKALEFLLESLGFASCSDVLPVYIGDDRTDEDAFKVLRKRGQGVGILVSKCAKETSASYSLQDPAEVMEFLLRLVDWKRRSSAPPMVRPRV

SEQ ID NO: 1187 - DNA, 1462 bp, Triticum aestivum
  misc_feature: Ceres CLONE ID no.941845
  misc_feature: Encodes the peptide sequence at SEQ ID NO 915
caggaaaaaaccggtctggtcccctcgtcctcggtgaactattccccactgtcactactgggcaccactctcacgcagcgggaggcgcgtgtcgtgagcacacgtgtggttgtttgcgtgcgccatggcgaaccaggacgtggtgctccgcccggacatgggcggcatagcttcggccgcggccatgccgggctcctccagccgcccgatcttcgcgtgccgcggcgccgcgtcgacctccctgcggcgccgctccggcgtcgacgacgactacggcgcccggtcaccctgcgccacaagctgggtcgtccaggccatgcgggcgtcttcgccggctcgctccgcagctgtcgacgagtacgccgcgtggacgaggaagcacccgtcggctctggctagcttcgagcagatcgcggcctccgccaaggggaagcaggtggtcgtgttcctggactacgacggcacgctctcgcccatcgtcgccgaccccgacacggcgttcatcaccggcgagatgcgggaggcggtgcgcggcgttgcgaagcacttcccggcggcgatcgtcaccggccggtgcgtggagaaggtgtgcagcttcgtaggcctctcggagctctactacgcgggcagccacggcatggacatcaagggcccaggctccaacgcggaggaggtcctcctgcaacctgctcgcgagttcctcccggtcatcgccgaggtctacgaggctctggtggagaagaccaagagcacgccgggggccagggtggagaacaagttctgcctctccgtgcacttccggtgcgtagatgaaaagagatggagtccattggccgagcaagtcaaggaggtgctccgggactaccccgatctcaggctcaacgaaggcagaaaggtcctggagatccggccgtccatcatgtgggacaagggcaaggccgtggagttcttgctccaatctctgggattcgacggacgcagcgacgtcctgccgctgtacctcggggacgaccgcactgacgaggatgctttcaagatgctgagaaagagaggtcatggcctcggcatccttgtctccaagtgccctagggagaccgacgcctcctactctcttcaggaccccactgaggttatggagttccttcaccgcttggtgcagtggaagcgccggcgatcatcatcgtcatcgtcagcgatgcgcgcaagagtgtagcgcagtcacagactgccacatcagcggctgctgctggcactgatttatcaagaagcttcagcatgtttaattaagtactccctccgtaaactaatataagagcatttagaatactaaagtagtgatctaaacgctcttatattagtttacaaagggagtagtttgttagctaatttggttgtacttattccatgcatgtaataaccatcgcctatgtctagttcccgcttttgaaaaaaaaaaaaaaaa

SEQ ID NO: 1188 - protein, 208 aa, Gossypium hirsutum
  misc_feature: Ceres Clone ID no. 100021678
  misc_feature (1)..(208): Bit score of 103.8 for hmm based on sequences of FIGURE 13.
  misc_feature (127)..(208): Pfam Name: Synaptobrevin Pfam Description: Synaptobrevin
  misc_feature: Functional Homolog Of SEQ ID NO. 160
MSLEPFIYSFVARGTMILAEYTEFTGNFPAIATQCLQKLPSSNNKFTYNCDHHTFNFLVEDGYAYCVVAKDSVGKQISIAFLERIKADFKKRYGGGKADTAIAKSLNKEFGPVMKEHMKYIIEHAEEIEKLLKVKAQVSEVKSIMLENIDKAIDRGENLTTLADRTENLRDQAQAYRNQGTKIRRKMWYQNMKIKLVVLGILVLLILV

SEQ ID NO: 1189 - protein, 129 aa, Panicum virgatum
  misc_feature: Ceres CLONE ID no.1821214
  misc_feature: Bit score of 100.1 for HMM based on sequences of FIGURE 15.
  misc_feature (19)..(43): Pfam Name: zf-A20 Pfam Description: A20-like zinc finger
  misc_feature (111)..(121): Pfam Name: zf-AN1 Pfam Description: AN1-like zinc finger
  misc_feature: Functional Homolog Of Ceres SEEDLINE ID no. ME02401 at SEQ ID NO. 749
  misc_feature (24)..(24): Xaa is any aa, unknown, or other
  misc_feature (78)..(78): Xaa is any aa, unknown, or other
MAQRDKKVEEPTELHAPELTLCAXSCGFPGNPATNNLCQNCFVAASASVSPFFPSSSSSAPSPAVFDKPRPAVAPTAXWPPFPAAADRPPAGPAESLSEAPRTSPSVTRGHSCRKPVGLTGSRGRCREL

SEQ ID NO: 1190 - DNA, 476 bp, Brassica napus
  misc_feature: Ceres CLONE ID no.1040399
  misc_feature: Encodes the peptide sequence at SEQ ID NO. 1191
  misc_feature (471)..(471): n is a, c, t, g, unknown, or other
acattccattcatttcctctctctctctctctctctcctctgattctctctatacgacccgtgagctcgccggaggagggtgaaaccaataaagatggcgcagaggacggagaaggaagagacggagttcaaggtcctcgaatccctgacgacccccgccaccgccacgaccacgctctgctcaaataactgcggcgtyacagcgaatccagccaccaacaacatgtgtcagaaatgtttcaacgcttccatcgccgccgccggcgtagactccggttcgacgttgaagagagcgtcgagatccgtcaatcttaggcccacgccagccaaagtcgtgatccgtcccagggagatcgatccggttaagagagatcagcagacggtaaaccggtgttccggttgtcggaagaaggtcgggctgaccgggttcagatgccgatgcggtaaccttttctgctccgagcaccgttnctccg

SEQ ID NO: 1191 - protein, 127 aa, Brassica napus
  misc_feature: Ceres CLONE ID no.1040399
  misc_feature: Bit score of 156.5 for HMM based on sequences of FIGURE 15.
  misc_feature (100)..(125): Pfam Name: zf-AN1 Pfam Description: AN1-like Zinc finger
  misc_feature (26)..(50): Pfam Name: zf-A20 Pfam Description: A20-like zinc finger
  misc_feature: Functional Homolog Of Ceres SEEDLINE ID no. ME02401 at SEQ ID NO. 749
  misc_feature (35)..(35): Xaa is any aa, unknown, or other
  misc_feature (126)..(126): Xaa is any aa, unknown, or other
MAQRTEKEETEFKVLESLTTPATATTTLCSNNCGXTANPATNNMCQKCFNASIAAAGVDSGSTLKRASRSVNLRPTPAKVVIRPREIDPVKRDQQTVNRCSGCRKKVGLTGFRCRCGNLFCSEHRXS

SEQ ID NO: 1192 - DNA, 437 bp, Brassica napus
  misc_feature: Ceres CLONE ID no.1093691
  misc_feature: Encodes the peptide sequence at SEQ ID NO. 1193
atatttcccattcatttcctctctcttctctctcaacaccattcgcaagctcgccggagaaaatcaacaacgcagatggcgcagagaacagagaaggaagagacggagttcaaggtcctcgaaaccttgacgacgacaacaaccccgacgctctgctccaacaactgcggcgtcacagcgagtccatcaaccaacaacatgtgccagaaatgtttcaacgccggtatagatccaactccgatcgcaaaaagatcagccagatccgtcagtctccggtcaacgccagccaaagctgcgatccgtcccagggagaccgatccggtcaagagagaccaccatcaacagaccgtaaaccgatgctccggttgtcggaagaaagtcgggttgaccggattcagatgccgatgcggcgatcttttctgcgcggagcacgctac

SEQ ID NO: 1193 - protein, 120 aa, Brassica napus
  misc_feature: Ceres CLONE ID no.1093691
  misc_feature: Bit score of 124.4 for HMM based on sequences of FIGURE 15.
  misc_feature (24)..(48): Pfam Name: zf-A20 Pfam Description: A20-like zinc finger
  misc_feature (95)..(119): Pfam Name: zf-AN1 Pfam Description: AN1-like Zinc finger
  misc_feature: Functional Homolog Of Ceres SEEDLINE ID no. ME02401 at SEQ ID NO. 749
MAQRTEKEETEFKVLETLTTTTTPTLCSNNCGVTASPSTNNMCQKCFNAGIDPTPIAKRSARSVSLRSTPAKAAIRPRETDPVKRDHHQQTVNRCSGCRKKVGLTGFRCRCGDLFCAEHA

SEQ ID NO: 1194 - DNA, 857 bp, Gossypium hirsutum
  misc_feature: Ceres CLONE ID no.1847516
  misc_feature: Encodes the peptide sequence at SEQ ID NO. 1195
atacgcgtctctatgaggcccatattccgtcgccattactgaccgacctttctcgaccccttcaaatcccctctctctctctctctccttaattccaacgccaacgccccctaattttctctccaaccaaacactcattctctccttcctctctatcctccccttcaaatttgttgttttccttttcctccttcgaaatcagctcaaggagatatggctcaaagaaccgaaaaagaagagactgaattcaaagtccctgaaaccctgacgctatgcgttaacaactgcggggttacgggtaatccagccaccaacaacatgtgccagaagtgttttagtgccaccacggccgcaacatcctcctcttcctcttcctcttccaccaacaacaccgctacttccgctaccgacgataaatcctcgagatctacgccgactcgttcacaggacaatcgatccgattccgctccacctacaacagctgcaacaacggcaacagcaacgacgaatagtccgatgaccgcttcaaatcggtctggatacgataccgcggaaaagaagtcggtgaatcgatgttctggttgcagaaaacgcgttgggttgaccgggttccggtgtcgatgcggggagcttttctgttcggaccatcggtactcggatcgacacgattgtagctacgactacaaggcggcgggtcgcgaagccatcgctagagaaaatcccgtggttaaagcagccaagattatcagagtttgagtttttaccaaatggatccaaattaaattaaataaactattcaaaacatttttcgacctgaaaatagcaagttgtggagatctatgctcgatctcaaatgg

SEQ ID NO: 1195 - protein, 180 aa, Gossypium hirsutum
  misc_feature: Ceres CLONE ID no.1847516
  misc_feature: Bit score of 365.1 for HMM based on sequences of FIGURE 15.
  misc_feature (121)..(161): Pfam Name: zf-AN1 Pfam Description: AN1-like Zinc finger
  misc_feature (18)..(42): Pfam Name: zf-A20 Pfam Description: A20-like zinc finger
  misc_feature: Functional Homolog Of Ceres SEEDLINE ID no. ME02401 at SEQ ID NO. 749
MAQRTEKEETEFKVPETLTLCVNNCGVTGNPATNNMCQKCFSATTAATSSSSSSSSTNNTATSATDDKSSRSTPTRSQDNRSDSAPPTTAATTATATTNSPMTASNRSGYDTAEKKSVNRCSGCRKRVGLTGFRCRCGELFCSDHRYSDRHDCSYDYKAAGREAIARENPVVKAAKIIRV

SEQ ID NO: 1196 - DNA, 444 bp, Brassica napus
  misc_feature: Ceres CLONE ID no.974539
  misc_feature: Encodes the peptide sequence at SEQ ID NO. 1197
ctctctctctcctctcctctcctctcctctcctctcctctctcaatacgatttgtaagctcgccggagtaaatcaacaacacagatggcgcagagaactgaaaaggaagagacagagttcaaggccctcgaaaccttgacgacgacaacaaccccgacgctctgctccaacaactgcggcgtcacagcgtgtccatcaaccaacaacatgtgccagaaatgtttcaacgccgccgccgccggtatagatccaaatccgatcgtaaaaagatcagccagatccgtcagtctccggtcaacgccagccaaagccgcgatccgtcccagggagaccgatccggtcaagagagaccatcatcaacagaccgtaaaccgatgctccggttgtcggaagaatgtcgggttgaccggattcagatgccgatgcggcgaccttttctgcgcg

SEQ ID NO: 1197 - protein, 120 aa, Brassica napus
  misc_feature: Ceres CLONE ID no.974539
  misc_feature: Bit score of 114.8 for HMM based on sequences of FIGURE 15.
  misc_feature (98)..(120): Pfam Name: zf-AN1 Pfam Description: AN1-like Zinc finger
  misc_feature (24)..(48): Pfam Name: zf-A20 Pfam Description: A20-like Zinc finger
  misc_feature: Functional Homolog Of Ceres SEEDLINE ID no. ME02401 at SEQ ID NO. 749
MAQRTEKEETEFKALETLTTTTTPTLCSNNCGVTACPSTNNMCQKCFNAAAAGIDPNPIVKRSARSVSLRSTPAKAAIRPRETDPVKRDHHQQTVNRCSGCRKNVGLTGFRCRCGDLFCA

SEQ ID NO: 1198 - DNA, 949 bp, Gossypium hirsutum
  misc_feature: Ceres CLONE ID no.1832340
  misc_feature: Encodes the peptide sequence at SEQ ID NO. 1199
aacgccccctaattttctctccaaccaaacactcattctctccttcctctctatcctccccttcaaatttgttgttttccttttcctccttcgaaatcagctcaaggagatatggctcaaagaaccgaaaaagaagagactgaattcaaagtccctgaaaccctgacgctatgcgttaacaactgcggggttacgggtaatccagccaccaacaacaccgctacttccgctaccgacgataaatcctcgagatctacgccgactcgttcacaggacaatcgatccgattccgctccacctacaacagctgcaacaacggcaacagcaacaacgaatagtccgatgaccgcttcaaatcggtctggatacgataccgcggaaaagaagtcggtgaatcgatgttctggttgcagaaaacgcgttgggttgaccgggttccggtgtcgatgcggggagcttttctgttcggaccatcggtactcggatcgacacgattgtagctacgactacaaggcggcgggtcgcgaagccatcgctagagaaaatcccgtggttaaagcagccaagattatcagagtttgagtttttaccaaatggatccaaattaaattaaataaactattcaaaacatttttcgacctgaaaatagcaagttgtggagatctatgctcgatctcaaaaggaaaaaaaaagtaaaaaaagactgtttcagagagggagaaatgagtcggtcgaaatcttgattacaaaaattcctggagatgaacaagatattctctcctctgattcttctggttggatcaaatctatagtattttcagtttactttttattattaatttagaaatgaaagattatcgagatttattagttgcagttgatatgtgttacggttactagaccccttccatgatcgagatcttatatatcgaggctttggtttagattg

SEQ ID NO: 1199 - protein, 156 aa, Gossypium hirsutum
  misc_feature: Ceres CLONE ID no.1832340
  misc_feature: Bit score of 305.5 for HMM based on sequences of FIGURE 15.
  misc_feature (97)..(137): Pfam Name: zf-AN1 Pfam Description: AN1-like Zinc finger
  misc_feature (18)..(34): Pfam Name: zf-A20 Pfam Description: A20-like Zinc finger
  misc_feature: Functional Homolog Of Ceres SEEDLINE ID no. ME02401 at SEQ ID NO. 749
MAQRTEKEETEFKVPETLTLCVNNCGVTGNPATNNTATSATDDKSSRSTPTRSQDNRSDSAPPTTAATTATATTNSPMTASNRSGYDTAEKKSVNRCSGCRKRVGLTGFRCRCGELFCSDHRYSDRHDCSYDYKAAGREAIARENPVVKAAKIIRV

SEQ ID NO: 1200 - DNA, 1133 bp, Panicum virgatum
  misc_feature: Ceres CLONE ID no.1961986
  misc_feature: Encodes the peptide sequence at SEQ ID NO. 1201
ttgcctttgcccgctgcgcttgcgcgtccgcggaaggggacgacgacgcgtccccgtctcctccccttccccgataaaaaggccgggcgcctctcgttcattcctcgctcatcgccgatcacaaccgcgccctccccccaatccccgattcgcgagctcgtccgcgcctcccggcctctcctccccacccccacccgccgcccctccgagaagcgaagcgaagctccgggccgcgccaccgcgcaggcaggcacccaaggcagcaggcgcgggttccttccgccaggtgcgcgggtaggcggcggcatggcgcagcgcgacaagaaggaggagcccacggagctccgggcgccggagatcacgctctgcgccaacaactgcggcttcccggggaacccggccacgcagaacctctgccagagctgcttctcggcggccacggcgtcgatgtcgtcgtcgccgacgtcctcctcgtcgtcctccacggccccggcgccggccgcgccgccccagccgaggccggcgccggcggagctggcctcccccgccgacgcggccgtggcggccccggctccggaggccgcgaaggcgccggcgaggacgtcggcgaaccggtgctcgagctgccggaagcgggtggggctgacggggttccggtgccggtgcggcgagctgttctgcggcgcgcaccggtactcggaccggcacggctgcagctacgactacaagggcgccgccagggacgccatcgcccgggagaacccggtggtgcgcgccgccaagatcgttaggttctgatcgacgacggagtcaaaattcctccatccatccacaggatcaagcaagcgaggaagacaaagaggaagcacacatccacggaaatggaaggccttttcccttggtgttactatgctgttcttcgaagcgtttgattttcaatctcctttttctttttacgatttctcaaatggaagaaaaaatgggaggaaaagaggtggacaaggaatagtgtaataataatgggggcaatgaggccgcggcggtggttgagagcaaaaggatcaacgcaatggattgggtgtatgtacctgtcacacgcaagctttgtgcaaaaactattatacatttctatc

SEQ ID NO: 1201 - protein, 163 aa, Panicum virgatum
  misc_feature: Ceres CLONE ID no.1961986
  misc_feature: Bit score of 357.8 for HMM based on sequences of FIGURE 15.
  misc_feature (104)..(144): Pfam Name: zf-AN1 Pfam Description: AN1-like Zinc finger
  misc_feature (18)..(42): Pfam Name: zf-A20 Pfam Description: A20-like zinc finger
  misc_feature: Functional Homolog Of Ceres SEEDLINE ID no. ME02401 at SEQ ID NO. 749
MAQRDKKEEPTELRAPEITLCANNCGFPGNPATQNLCQSCFSAATASMSSSPTSSSSSSTAPAPAAPPQPRPAPAELASPADAAVAAPAPEAAKAPARTSANRCSSCRKRVGLTGFRCRCGELFCGAHRYSDRHGCSYDYKGAARDAIARENPVVRAAKIVRF

SEQ ID NO: 1202 - DNA, 699 bp, Gossypium hirsutum
  misc_feature: Ceres CLONE ID no.1933211
  misc_feature: Encodes the peptide sequence at SEQ ID NO. 1203
gaaaaaaaaaaaaaaaaaaaaaaaaaaaaaaaaaaaaaaaaaaaaaaaaaaaaaaaaaaaaacgccccctaattttctctccaaccaaacactaattctctccttcctctccatcctccccttcaaatttgttgttttccttttcctccttcaaaatcacctcaaggaaatatggctcaaaaaaccaaaaaaaaaaaaactgaattcaaagtacctgaaaccctgactctatgcgttaacaactggggggttacgggaaatccacccaccaacaacatgggccaaaaatgttttagttccaccacggccgccacatcctcctcttcctcttccaccaacaacaccgctacttccgctaccaacaaaaaatcctcaaaatctaccccaactcgttcacaggacaaccgatccaactccgctccgcctacaacagctgcaacaacggcaacagcaacagcaacaacaaatagtccaatgactgcttcaaatcggtctggatacaataccgcgaaaaaaaagtcggtgaatcgatgttctggttgcaaaaaacgcgttgggttgacggggttccggtgtcaatgcggggagcttttctgttcggaccatcggtactcgaatcgacacaattgtagctacaactacaaggcggcgggtcgcgaagccatcgctagggaaaatcccgtggttaaagcacccaaa

SEQ ID NO: 1203 - protein, 176 aa, Gossypium hirsutum
  misc_feature: Ceres CLONE ID no.1933211
  misc_feature: Bit score of 272.5 for HMM based on sequences of FIGURE 15.
  misc_feature (121)..(161): Pfam Name: zf-AN1 Pfam Description: AN1-like Zinc finger
  misc_feature (18)..(42): Pfam Name: zf-A20 Pfam Description: A20-like Zinc finger
  misc_feature: Functional Homolog Of Ceres SEEDLINE ID no. ME02401 at SEQ ID NO. 749
MAQKTKKKKTEFKVPETLTLCVNNWGVTGNPPTNNMGQKCFSSTTAATSSSSSSTNNTATSATNKKSSKSTPTRSQDNRSNSAPPTTAATTATATATTNSPMTASNRSGYNTAKKKSVNRCSGCKKRVGLTGFRCQCGELFCSDHRYSNRHNCSYNYKAAGREAIARENPVVKAPK

SEQ ID NO: 1204 - DNA, 1064 bp, Zea mays
  misc_feature: Ceres CLONE ID no.997558
  misc_feature: Encodes the peptide sequence at SEQ ID NO. 1205
ctcgcccgctcgctccgcgctccctccccccctcccgcgcggatcacagacaggctcacggtcacggccggcctcccaattcgcaacctcgcctccgcctctcctcctacccctccgaaaaagcaagctccggccgggccgccaccaccaccaccgcgcgcgcgtgcacgcgctcccacacacagacagacagacagacagacagagtgagagacgcacggtggttcggggtctcccttctgccaggcgcacgaggagccatggcgcagcgcgacaagaaggaggagcccacggagctccgggcgccggagatcacgctgtgcgccaacaactgcgggttcccgggtaacccggccacgcagaacctgtgccagagctgcttctcggcgtcgaggtcgccgtcgtcccctacctcctcctcctcttccctggcgtccgcggcgtcgcagccgaggccagcagcgctcgtcgtagacgcggcagcggtggaggcgctggccgctccggcggccgcggccgtgggccaggctacggaagccgcggcgagggcgtccgcgagccggtgctccagctgccggaagcgcgtggggctgacggggttccggtgccgctgcggcgagctcttctgcggcgcgcaccggtactcggaccggcacggctgcagctacgactacaggggcgccgcccgggacgccatcgcccgggagaacccggtggtgcgcgcggccaaggtcgttaggttctgatgacgggaaggaaggaaggacacagcacaaaggctcgcagggcggagaaggggaggaggaaggcgtgcggacaaggtcttcggtgttattattattacgctgttcctttgattttaatctcctttttttttaaaaaaatatttgtcctatgggaatgggattgggagaagaggtggacgaagaatagtggagtaataataatggtggtggtgcagtggcggtggttgagggcccgaaacgatgaacagatgggttggattgggttgggtgtatgtatgtgtcacacgcaactttggacagaactattatactagtact

SEQ ID NO: 1205 - protein, 161 aa, Zea mays
  misc_feature: Ceres CLONE ID no.997558
  misc_feature: Bit score of 316.1 for HMM based on sequences of FIGURE 15.
  misc_feature (102)..(142): Pfam Name: zf-AN1 Pfam Description: AN1-like Zinc finger
  misc_feature (18)..(42): Pfam Name: zf-A20 Pfam Description: A20-like zinc finger
  misc_feature: Functional Homolog Of Ceres SEEDLINE ID no. ME02401 at SEQ ID NO. 749
MAQRDKKEEPTELRAPEITLCANNCGFPGNPATQNLCQSCFSASRSPSSPTSSSSSLASAASQPRPAALVVDAAAVEALAAPAAAAVGQATEAAARASASRCSSCRKRVGLTGFRCRCGELFCGAHRYSDRHGCSYDYRGAARDAIARENPVVRAAKVVRF

SEQ ID NO: 1206 - DNA, 531 bp, Sorghum bicolor
  misc_feature: Ceres ANNOT ID no.6091930
  misc_feature: Encodes the peptide sequence at SEQ ID NO. 1207
atggcgcagcgcgacaagaaggtggaggagccgacggagctgcgggcgccggagctcacgctgtgcgccaacagctgcggcttcccggggaacccggccaccaacaacctctgccaggcctgcttccaggccgccacggcttcctccgcctcagcctccgtctcgccgccgtcgccttcctcctcgttgtctccgtccccggcggtgttcaagttcgacgagcagcagcacgcgaggccgtctgcgacggcggtgttcgccgaccggcctgcggagcaaccgccggcgccggcgtccgccaggccgatccggacgacgtcgacttcgtcgtcgtcgtccgtcaaccggtgccagagctgccggaagcgcgtcgggctgacggggttccggtgccgctgcggggagctcttctgcggcgcgcaccgctactcggaccgccacgactgctgcttcgactacaaggccgtcggcagggacgccatcgccagggagaaccccgtcgtgcgcgccgccaagatcgtcaggttctga

SEQ ID NO: 1207 - protein, 176 aa, Sorghum bicolor
  misc_feature: Ceres ANNOT ID no.6091930
  misc_feature: Bit score of 355.6 for HMM based on sequences of FIGURE 15.
  misc_feature (117)..(157): Pfam Name: zf-AN1 Pfam Description: AN1-like Zinc finger
  misc_feature (19)..(43): Pfam Name: zf-A20 Pfam Description: A20-like zinc finger
  misc_feature: Functional Homolog Of Ceres SEEDLINE ID no. ME02401 at SEQ ID NO. 749
MAQRDKKVEEPTELRAPELTLCANSCGFPGNPATNNLCQACFQAATASSASASVSPPSPSSSLSPSPAVFKFDEQQHARPSATAVFADRPAEQPPAPASARPIRTTSTSSSSSVNRCQSCRKRVGLTGFRCRCGELFCGAHRYSDRHDCCFDYKAVGRDAIARENPVVRAAKIVRF

SEQ ID NO: 1208 - DNA, 798 bp, Sorghum bicolor
  misc_feature: Ceres ANNOT ID no.6041596
  misc_feature: Encodes the peptide sequence at SEQ ID NO. 1209
atggcgcagcgcgacaagaaggaggagcccacggagctccgggcgccggagatcacgctgtgcgccaacaactgcggcttcccggggaacccggccacgcagaacctgtgccagagctgcttctcggcggccacggcgtcgaggtcgtcgtcgccgtcgtcccctacctcctcttcctcagcttcagcggtgtcgcagccgaggccggcggcactcgtagacgcagcagcggtggagctgctggcctctgcggatgccgcagccgtgggccagtctatggaggtcgtcgccgccgctccggcggccacggcggcgaggtcgtctgctgtgaaccggtgctccagctgccggaagcgggtggggctgacggggttccggtgccggtgcggcgagctcttctgcggcgcgcaccggtactcggaccggcacggctgcagctacgactacaagggcgccggcagggacgccatcgcccgggagaacccggtggtggcccaaaacgatgaacaaatgggttgggttgggttgggttgggttgggtgtatgtatctgtcacacgcaactttgtgcaaaaactattatactacgagtacgtttctcgtctctctcgtacagaaaacaccagcacgagcgatgattggtcaatcattcgtcaggcaggctcgtatactagtaatcatctctgccgatcccggaagtattttttacagactttttcagaccgaaagattgagaagcgatcaactcctctttccgcagaagaattatgcccccgtgtgtggcccacctgctccataa

SEQ ID NO: 1209 - protein, 265 aa, Sorghum bicolor
  misc_feature: Ceres ANNOT ID no.6041596
  misc_feature: Bit score of 291.0 for HMM based on sequences of FIGURE 15.
  misc_feature (113)..(153): Pfam Name: zf-AN1 Pfam Description: AN1-like Zinc finger
  misc_feature (18)..(42): Pfam Name: zf-A20 Pfam Description: A20-like zinc finger
  misc_feature: Functional Homolog Of Ceres SEEDLINE ID no. ME02401 at SEQ ID NO. 749
MAQRDKKEEPTELRAPEITLCANNCGFPGNPATQNLCQSCFSAATASRSSSPSSPTSSSSASAVSQPRPAALVDAAAVELLASADAAAVGQSMEVVAAAPAATAARSSAVNRCSSCRKRVGLTGFRCRCGELFCGAHRYSDRHGCSYDYKGAGRDAIARENPVVAQNDEQMGWVGLGWVGCMYLSHATLCKNYYTTSTFLVSLVQKTPARAMIGQSFVRQARILVIISADPGSIFYRLFQTERLRSDQLLFPQKNYAPVCGPPAP

SEQ ID NO: 1210 - protein, 164 aa, Oryza sativa subsp. indica
  misc_feature: Public GI ID no.125564176
  misc_feature: Bit score of 310.1 for HMM based on sequences of FIGURE 15.
  misc_feature (105)..(145): Pfam Name: zf-AN1 Pfam Description: AN1-like Zinc finger
  misc_feature (19)..(43): Pfam Name: zf-AN1 Pfam Description: AN1-like Zinc finger
  misc_feature: Functional Homolog Of Ceres SEEDLINE ID no. ME02401 at SEQ ID NO. 749
MAQGDKKDQEPTELRAPEITLCANSCGFPGNPATQNLCQNCFLAATASTSSPSSLSSPVLDKQPPRPAAPLVEPQAPLPPPVEEMASALATAPAPVAKTSAVNRCSRCRKRVGLTGFRCRCGHLFCGEHRYSDRHGCSYDYKSAARDAIARDNPVVRAAKIVRF

SEQ ID NO: 1211 - DNA, 683 bp, Gossypium hirsutum
  misc_feature: Ceres CLONE ID no.1836064
  misc_feature: Encodes the peptide sequence at SEQ ID NO. 1212
atacgcgtctctatgaggcccatattccgtcgccattactgaccgacctttctcgaccccttcaaatcccctctctctctctctctccttaattccaacgccaacgccccctaattttctctccaaccaaacactaattctctccttcctctccatcctccccttcaaatttgttgttttccttttcctccttcgaaatcacctcaaggagatatggctcaaagaaccgaaaaagaagagactgaattcaaagtacctgaaaccctgactctatgcgttaacaactgcggggttacggggaatccagccaccaacaacatgtgccagaaatgttttagttccaccacggccgccacatcctcctcttcctcttccaccaacaacaccgctacttccgctaccgacgataaatcctcgagatctacgccgactcgttcacaggacaaccgatccgactccgctccgcctacaacagctgcaacaacggcaacagcaacagcaacgacgaatagtccgatgactgcttcaaatcggtctggatacgataccgcggaaaagaagtcggtgaatcgatgttctggttgcagaaaacgcgttgggttgacggggttccggtgtcgatgcggggagcttttctgttcggaccatcggtactcggatcgacacgattgtagctacgacta

SEQ ID NO: 1212 - protein, 156 aa, Gossypium hirsutum
  misc_feature: Ceres CLONE ID no.1836064
  misc_feature: Bit score of 235.9 for HMM based on sequences of FIGURE 15.
  misc_feature (121)..(156): Pfam Name: zf-AN1 Pfam Description: AN1-like Zinc finger
  misc_feature (18)..(42): Pfam Name: zf-A20 Pfam Description: A20-like zinc finger
  misc_feature: Functional Homolog Of Ceres SEEDLINE ID no. ME02401 at SEQ ID NO. 749
MAQRTEKEETEFKVPETLTLCVNNCGVTGNPATNNMCQKCFSSTTAATSSSSSSTNNTATSATDDKSSRSTPTRSQDNRSDSAPPTTAATTATATATTNSPMTASNRSGYDTAEKKSVNRCSGCRKRVGLTGFRCRCGELFCSDHRYSDRHDCSYD

SEQ ID NO: 1213 - DNA, 1100 bp, Panicum virgatum
  misc_feature: Ceres CLONE ID no.1909693
  misc_feature: Encodes the peptide sequence at SEQ ID NO. 1214
cccccccaaacccatttccttcctgcctccacgacccagcccaggcccggcggtgcctctccctctcgtctccggatcggcaagagcccagctgctgccggattcacacgacacctcgtcgtctctctctctctctctctctctctctctctctctctctctctctctctctcggcccatggcgcagcgcgacaagaaggtggaggagccgacggagctgcacgcgccggagctcacgctctgcgccaacagctgcggcttcccgggcaacccggcgaccaagaacctctgccagaactgcttcctggccgcctcggcctccgtgtcgccgccgtcgccctcctcctcctcctcgtcgccctcgccggcggtgttcgacaagccgcggccggcggtcgcccctaccgccgtgtggccgccgttccccgcggccgccgaccggcccccggcgggccccgcggagtccccctccaaggcgccccggacgtcgtcgtcggtcaaccggtgccacagctgccggaagcgggtcgggctgacggggttccggtgccgctgcggcgagctcttctgcggcgcgcaccggtactcggaccgccacgactgcggctacgactacaagggcgttgcccgggacgccatcgcccgggagaaccccgtcgtgcgcgccgccaagatcgtcaggttctgagagctggggagcaccggaggagaccacgcagctcagctccacgccgatcgtcgatccatctcccgcgctccggaatccccctctctgtttttctcttttctttcctttttacaaaagtttaaaaaggtgattagtcgaggtgctatcatcatgctgttcttgagaattccacaaagaagaagaagaagatgatgatgatcaaggaaaaaggaggagcggatcatggcaaatcatgatgaaggaaaaagggaatcgagagcacagtgcgatgataatgttgtagcggtggttgggggtggagataggggtcggtttggtgtgttgtcctactacaaatcacaatcttctattaaatttttcttccatctctctctgtataaactaaattataattggaatctccctattgccc

SEQ ID NO: 1214 - protein, 169 aa, Panicum virgatum
  misc_feature: Ceres CLONE ID no.1909693
  misc_feature: Bit score of 336.3 for HMM based on sequences of FIGURE 15.
  misc_feature (110)..(150): Pfam Name: zf-AN1 Pfam Description: AN1-like Zinc finger
  misc_feature (19)..(43): Pfam Name: zf-A20 Pfam Description: A20-like Zinc finger
  misc_feature: Functional Homolog Of Ceres SEEDLINE ID no. ME02401 at SEQ ID NO. 749
MAQRDKKVEEPTELHAPELTLCANSCGFPGNPATKNLCQNCFLAASASVSPPSPSSSSSSPSPAVFDKPRPAVAPTAVWPPFPAAADRPPAGPAESPSKAPRTSSSVNRCHSCRKRVGLTGFRCRCGELFCGAHRYSDRHDCGYDYKGVARDAIARENPVVRAAKIVRF

SEQ ID NO: 1215 - protein, 137 aa, Phaseolus vulgaris
  misc_feature: Public GI ID no.169363
  misc_feature: Bit score of 195.2 for HMM based on sequences of FIGURE 7.
  misc_feature (78)..(118): Pfam Name: zf-AN1 Pfam Description: AN1-like Zinc finger
  misc_feature (18)..(43): Pfam Name: zf-AN1 Pfam Description: AN1-like Zinc finger
  misc_feature: Functional Homolog Of Ceres SEEDLINE ID no. ME04477 at SEQ ID NO. 742
MAQKAQKNDTDFKVPEPITPCATATAAAATSISEPSRFFDAATPATSSRSPKRSLPLEDAANADRTVASEPKRAVNRCSGCRRRVGLTGFRCRCGDLFCAEHRYTDRHDCSYDYKTVGREAIARENPVVKAAKIVKV

SEQ ID NO: 1216 - protein, 180 aa, Gossypium hirsutum
  misc_feature: Ceres Clone ID no.100041169
  misc_feature: Bit score of 439.2 for HMM based on sequences of FIGURE 15.
  misc_feature (121)..(161): Pfam Name: zf-AN1 Pfam Description: AN1-like Zinc finger
  misc_feature (18)..(42): Pfam Name: zf-A20 Pfam Description: A20-like Zinc finger
  misc_feature: Functional Homolog Of Ceres SEEDLINE ID no. ME02401 at SEQ ID NO. 749
MAQRTEKEETEFKVPETLTLCVNNCGVTGNPATNNMCQKCFSSTTAATSSSSSSTNNTATSATDDKSSRSTPTRSQDNRSDSAPPTTAATTATATATTNSPMTASNRSGYDTAEKKSVNRCSGCRKRVGLTGFRCRCGELFCSDHRYSDRHDCSYDYKAAGREAIARENPVVKAAKIIRV

SEQ ID NO: 1217 - DNA, 824 bp, Panicum virgatum
  misc_feature: Ceres CLONE ID no.1765346
  misc_feature: Encodes the peptide sequence at SEQ ID NO. 1218
gaacggggcggagcgacttcagaagaggtcgacccgcaccccttgcaggttgagaatcccaagctcccacccgcagtccgcagacacgctccgccgcttcgccccaattcccaaccaccaccaccttcacttcacctcgaccgaaccgatggagcagcaagggagcgagaacacgcaggagccgctcccctgcgccaacaactgcggtttcttcggctccccggccacgcgcaacctctgctccaagtgcttccgcgacagcctccgccacgccgaggcccaggcggtggcggcgacagcgacagcgacggccgcgctcgccgcctcttcttctccggccgcggcgtcagcggatcccgacgcggcgacagcggcagcgacggaggaggcggggaaggcgcgagcgaaggggaagaagagcggccggtgcgcggcgtgcgggaggaaggtggggctgatggggttcgagtgccggtgcggcggcgtcttctgcggcgcgcaccgctactcggaccggcacgactgcggctacgactacaggggcgccggccgcgacgccatcgcccgcgccaaccccgtcgtcagggccgacaagcaggtcgacaagctctgaccgagcagcgccggcgcgtgctctgctctcaggcagcaaaccatcactggcctggcctggctgctcgatcgaagattcgaagtatgcagtatgcttgattgaagtctagtcgattgcaattcgcgtcaacatctctgtacctcttcgctagttcatgatgtatatttgctatacctacctgctgctagtgcagttgcttgttaacagacag

SEQ ID NO: 1218 - protein, 154 aa, Panicum virgatum
  misc_feature: Ceres CLONE ID no.1765346
  misc_feature: Bit score of 168.4 for HMM based on sequences of FIGURE 15.
  misc_feature (12)..(36): Pfam Name: zf-A20 Pfam Description: A20-like zinc finger
  misc_feature (94)..(134): Pfam Name: zf-AN1 Pfam Description: AN1-like Zinc finger
  misc_feature: Functional Homolog Of Ceres SEEDLINE ID no. ME02401 at SEQ ID NO. 749
MEQQGSENTQEPLPCANNCGFFGSPATRNLCSKCFRDSLRHAEAQAVAATATATAALAASSSPAAASADPDAATAAATEEAGKARAKGKKSGRCAACGRKVGLMGFECRCGGVFCGAHRYSDRHDCGYDYRGAGRDAIARANPVVRADKQVDKL

SEQ ID NO: 1219 - protein, 213 aa, Oryza sativa subsp. indica
  misc_feature: Public GI ID no.125546008
  misc_feature: Bit score of 190.7 for HMM based on sequences of FIGURE 15.
  misc_feature (154)..(194): Pfam Name: zf-AN1 Pfam Description: AN1-like Zinc finger
  misc_feature (74)..(98): Pfam Name: zf-A20 Pfam Description: A20-like zinc finger
  misc_feature: Functional Homolog Of Ceres SEEDLINE ID no. ME02401 at SEQ ID NO. 749
MGGIPFENGSSPIRQGSSSQLLLPLGDQMQWSFISTILCDLEPYWQVQLVFLTMAQESWKKEAEETGVHTPEAPILCVNNCGFFGSRMTENMCSKCYRDTVKAKTVATVVEKKPLASLSSTPLVAEVTDGGSGSVADGKQVMEEDTPKPPSNRCLSCRKKVGLTGFKCRCGGTFCSMHRYADSHKCTFDYKQAGREQIAKQNPLVKADKITKI

SEQ ID NO: 1220 - DNA, 915 bp, Panicum virgatum
  misc_feature: Ceres CLONE ID no.1950900
  misc_feature: Encodes the peptide sequence at SEQ ID NO. 1221
ctcccgacgctcgacccgaaaaaaaatattctccgcggggggtaagggaaaggtcgcgtggcgtctcgcccacagtccatcggtagcaatggcacaagagagctggaaacaagagtccgaggagactagagtccacgcgcctgaggcccctattctctgcataaacaactgtggtttctttggcagcagcatgacgaacaatatgtgctcgaagtgctatagggacttcatcaagttgatggaagctcctgtggtggagaagaaggtgaccacatcagcatcttcttccacagcaccactggagacaaagcgagatgatgcgcctgccgctgctgccactgaagctgtggctgagaagcaagcagagcaagagcccccaaagccacccagcaaccggtgtctgacttgccgcaagaaggtcgggctgaccggcttcctctgccgttgcgggggcaccttctgctccacgcaccgctacaccgactcccaccagtgcacctttgactataagaaggtggcacgggagcagatagccaagcagaatccagttgtgatggccgagaagataaacaagatctaatgaatggttgtgaagggattcatgcctgggttcctgagtcctcaagttcactataatcgataggttccttcgggtggtggtctgggttagcgtggtagtagggggtctcaattgtgtctatccttctcctttatcatggttccattctctgccggaaagatgcagtggttttgcgtcgtcacttcctctggaagtagtttaagtcgagaagataagattgcacatcaggtattgcttattctggtcctggagggccaagtgttgtatcgacatgtcattggttttgtatcgttgtatgttatcacgtgtgctggaaatcacagcaagtatgaagt

SEQ ID NO: 1221 - protein, 163 aa, Panicum virgatum; identical to SEQ ID NO: 957
  misc_feature: Ceres CLONE ID no.1950900
  misc_feature: Bit score of 192.3 for HMM based on sequences of FIGURE 15.
  misc_feature (104)..(144): Pfam Name: zf-AN1 Pfam Description: AN1-like Zinc finger
  misc_feature (21)..(45): Pfam Name: zf-A20 Pfam Description: A20-like zinc finger
  misc_feature: Functional Homolog Of Ceres SEEDLINE ID no. ME02401 at SEQ ID NO. 749

SEQ ID NO: 1222 - protein, 233 aa, Zea mays
  misc_feature: Public GI ID no.41350259
  misc_feature: Bit score of 187.5 for HMM based on sequences of FIGURE 15.
  misc_feature (174)..(214): Pfam Name: zf-AN1 Pfam Description: AN1-like Zinc finger
  misc_feature (73)..(97): Pfam Name: zf-A20 Pfam Description: A20-like zinc finger
  misc_feature: Functional Homolog Of Ceres SEEDLINE ID no. ME02401 at SEQ ID NO. 749
MVSSPFDLKIWGFGSASRARSGPSSFFPLLYLIGFFASFTQGSSERNRKEGRLIRVKEAMEHKEAGCQAPEGPILCINNCGFFGSAATMNMCSKCHKEMITKQDQAKLAASSIDSIVDGSDAVMEPGGAGSNTVVAVAQVELQKKNVQQPADVAEPNEGVAAISKGGKVGPNRCSACRKRVGLTGFNCRCGNLYCALHRYSDKHDCKFDYRTAARDAIAKANPVVKADKLDKI

SEQ ID NO: 1223 - protein, 213 aa, Oryza sativa subsp. japonica
  misc_feature: Public GI ID no.125588210
  misc_feature: Bit score of 189.3 for HMM based on sequences of FIGURE 15.
  misc_feature (154)..(194): Pfam Name: zf-AN1 Pfam Description: AN1-like Zinc finger
  misc_feature (74)..(98): Pfam Name: zf-A20 Pfam Description: A20-like zinc finger
  misc_feature: Functional Homolog Of Ceres SEEDLINE ID no. ME02401 at SEQ ID NO. 749
MGGIPFENGSSPIRQGSSSQLLLPLGDQMQWSFISTILCDLEPYWQVQLVFLTMAQESWKKEAEETGVHTPEAPILCVNNCGFFGSRMTENMCSKCYRDTVKAKTVATVVEKKPLASLSSTPLVTEVTDGGSGSVADGKQVMEEDTPKPPSNRCLSCRKKVGLTGFKCRCGGTFCSMHRYADSHKCTFDYKQVGREQIAKQNPLVKADKITKI

SEQ ID NO: 1224 - DNA, 820 bp, Panicum virgatum
  misc_feature: Ceres CLONE ID no.1954395
  misc_feature: Encodes the peptide sequence at SEQ ID NO. 1225
gccctcgccctcgccttcgccttcgcctacctctcgacgcccaaccccaaaaagaaaaattctcctcgcggagaaaggtcgcgtgccgtctcgcccacagcccatctgtaacaatggcacaggagagctggaaacaggaatctgaggagactggagtccatgcacctgaggccccaattctgtgcataaacaactgtggtttcttcggcagcagcatgacgaacaatatgtgctcgaagtgctacagggacttcatcaaattgatggaaggccctgtggttgagaagaaggtgatcacggtggcatcttcttctgcggcaccaatggagacagcaaagcaagatgatgtgcctgcagctgctgccactgaagctgtgacggagaagcaagcagagcaggagccgccaaagccgcccagcaaccggtgccttacctgccgcaagaaggttgggctgactggcttcctctgccgctgcgggggcaccttctgctccatgcaccgctacactgactcccaccagtgcaccttcgactacaagaaggtggcacgggagcagattgccaagcaaaatccagttgtgatggcagagaagattaacaagatatgatgcatggtcatgtgaagggatcactaaattcatgcctgggtagtgggttcactccaaatgataggttccttcaggcggtggtctgggtctgggttagagtggtagctggtctcaattgtgtctatcctcctcctttatcatggtttcattctctcgattgtgtaataatgtaaatatattcaaactgtaatttaatcctattgcttcctact

SEQ ID NO: 1225 - protein, 164 aa, Panicum virgatum
  misc_feature: Ceres CLONE ID no.1954395
  misc_feature: Bit score of 189.5 for HMM based on sequences of FIGURE 15.
  misc_feature (105)..(145): Pfam Name: zf-AN1 Pfam Description: AN1-like Zinc finger
  misc_feature (21)..(45): Pfam Name: zf-A20 Pfam Description: A20-like zinc finger
  misc_feature: Functional Homolog Of Ceres SEEDLINE ID no. ME02401 at SEQ ID NO. 749
MAQESWKQESEETGVHAPEAPILCINNCGFFGSSMTNNMCSKCYRDFIKLMEGPVVEKKVITVASSSAAPMETAKQDDVPAAAATEAVTEKQAEQEPPKPPSNRCLTCRKKVGLTGFLCRCGGTFCSMHRYTDSHQCTFDYKKVAREQIAKQNPVVMAEKINKI

SEQ ID NO: 1226 - protein, 173 aa, Arabidopsis thaliana
  misc_feature: Public GI ID no.18403408
  misc_feature: Bit score of 150.6 for HMM based on sequences of FIGURE 15.
  misc_feature (114)..(154): Pfam Name: zf-AN1 Pfam Description: AN1-like Zinc finger
  misc_feature (15)..(39): Pfam Name: zf-A20 Pfam Description: A20-like zinc finger
  misc_feature: Functional Homolog Of Ceres SEEDLINE ID no. ME02401 at SEQ ID NO. 749
MDHDKTGCQSPPEGPKLCTNNCGFFGSAATMNMCSKCHKDMLFQQEQGAKFASAVSGTSSSSNIIKETFTAALVDIETKSVEPMTVSVQPSSVQVVAEVVAPEEAAKPKGPSRCTTCNKRVGLTGFKCRCGSLFCGTHRYADVHDCSFNYHAAAQEAIAKANPVVKAEKLDKI

SEQ ID NO: 1227 - DNA, 965 bp, Panicum virgatum
  misc_feature: Ceres CLONE ID no.2010121
  misc_feature: Encodes the peptide sequence at SEQ ID NO. 1228
cctggcccgacgacgcccccatttcgaggctcctccttgcgattccaatccccgcccgcctcctccgcctccgcgtccgcctcgcgcagggtttggcttatagtagtcatggaacacaaggagacgggctgccagcaaccggagggcccaatactatgcatcaacaactgtggcttctttggcagtgcggccaccatgaacatgtgctccaagtgccacaaggagatgataatgaagcaggagcattcccagctggctgcctcctccattgatagcattgtcaatggcggtgatggtgggaaaggccctatcatagctgcaaccgcagaggtggcggttgctcaagttgaggagaagactattgttgtgcagcctccatttgtagctgaaaccagcgaggctgctgccattatccccaaggccaaggaaggtccgaaccggtgcgcaacctgtaggaagcgggttggtctgacgggattcaactgccgatgcggtaacatgtactgtgcgttgcaccgctactccgacaaacatgactgccagtttgactaccagactgcagctagggatgcgattgccaaggccaatcctgtggtgaaggcggagaagcttgaaaagatctgaagggggcaatggggaacgaaatgggttgcgatctgcaagattcaatcatgcatctttgctgctttatcattgaacatcccattcttgtttgctgccacatccctgagtcgttcaacactatgatgctcacgcatcctggcagctgcaagaagtcatcctcagtcgagtccaaaatggtttgcgtgttggctatgttgtgtaagcttattcagttattcatggtggtttcagtcggtattgtggcatttccatttaggtagctctgtaatgtactactgtctcatgcgtgttacattccaatcagtaatagtaatcagcaatggtctgcaatatttcctctt

SEQ ID NO: 1228 - protein, 171 aa, Panicum virgatum
  misc_feature: Ceres CLONE ID no.2010121
  misc_feature: Bit score of 179.7 for HMM based on sequences of FIGURE 15.
  misc_feature (112)..(152): Pfam Name: zf-AN1 Pfam Description: AN1-like Zinc finger
  misc_feature (14)..(38): Pfam Name: zf-A20 Pfam Description: A20-like zinc finger
  misc_feature: Functional Homolog Of Ceres SEEDLINE ID no. ME02401 at SEQ ID NO. 749
MEHKETGCQQPEGPILCINNCGFFGSAATMNMCSKCHKEMIMKQEHSQLAASSIDSIVNGGDGGKGPIIAATAEVAVAQVEEKTIVVQPPFVAETSEAAAIIPKAKEGPNRCATCRKRVGLTGFNCRCGNMYCALHRYSDKHDCQFDYQTAARDAIAKANPVVKAEKLEKI

SEQ ID NO: 1229 - DNA, 519 bp, Sorghum bicolor; identical to SEQ ID NO: 804
  misc_feature: Ceres ANNOT ID no.6011486
  misc_feature: Encodes the peptide sequence at SEQ ID NO. 1230

SEQ ID NO: 1230 - protein, 172 aa, Sorghum bicolor; identical to SEQ ID NO: 805
  misc_feature: Ceres ANNOT ID no.6011486
  misc_feature: Bit score of 200.6 for HMM based on sequences of FIGURE 15.
  misc_feature (113)..(153): Pfam Name: zf-AN1 Pfam Description: AN1-like Zinc finger
  misc_feature (21)..(45): Pfam Name: zf-A20 Pfam Description: A20-like zinc finger
  misc_feature: Functional Homolog Of Ceres SEEDLINE ID no. ME02401 at SEQ ID NO. 749

SEQ ID NO: 1231 - protein, 173 aa, Arabidopsis thaliana
  misc_feature: Public GI ID no.25082726
  misc_feature: Bit score of 151.8 for HMM based on sequences of FIGURE 15.
  misc_feature (114)..(154): Pfam Name: zf-AN1 Pfam Description: AN1-like Zinc finger
  misc_feature (15)..(39): Pfam Name: zf-A20 Pfam Description: A20-like zinc finger
  misc_feature: Functional Homolog Of Ceres SEEDLINE ID no. ME02401 at SEQ ID NO. 749
MDHDKTGCQSPPEGPKLCTNNCGFFGSAATMNMCSKCHKDMLFQQEQGTKFASAVSGTSSSSNIIKETFTAALVDIETKSVEPMTVSVQPSSVQVVAEVVAPEEAAKPKGPSRCTTCNKRVGLTGFKCRCGSLFCGTHRYADVHDCSFNYHAAAQEAIAKANPVVKAEKLDKI

SEQ ID NO: 1232 - protein, 173 aa, Camellia sinensis; identical to SEQ ID NO: 798
  misc_feature: Public GI ID no.113196593
  misc_feature: Bit score of 384.7 for HMM based on sequences of FIGURE 15.
  misc_feature (114)..(154): Pfam Name: zf-AN1 Pfam Description: AN1-like Zinc finger
  misc_feature (15)..(39): Pfam Name: zf-A20 Pfam Description: A20-like zinc finger
  misc_feature: Functional Homolog Of Ceres SEEDLINE ID no. ME02401 at SEQ ID NO. 749

SEQ ID NO: 1233 - DNA, 972 bp, Gossypium hirsutum
  misc_feature: Ceres CLONE ID no.1843021
  misc_feature: Encodes the peptide sequence at SEQ ID NO. 1234
ttttctgctatcagtttcattacataatatatctcttcgattaaagaatcgctgggttcgattttgtcagacaagatcggccaaattaagatttcaggagattagagaagatggaccctcatgatgagacgggccgccaagcttcagaaggccccatcctgtgtgttaataactgtggtttctttggaagtgcggcgaccatgaatatgtgctccaaatgtcacaaggcaatgatcctgaagcaggaacaggcacaactcgtagcatcatccatcgatagcattgttaatggcagcactagcgggaatggtaaggaaccatctgttgctgctgctttggctgtgcaatgtggaaattttgggtcaaaaattgaatcatccatcgatccatcccatatgaccttcggtgggatgaaaacaaaagagggtcccaacaggtgtaatgcatgccacaagcgtgttggtttgacaggatttagctgcaggtgtggaaacatcttctgtgcagcacataggtactctgacaaacacaactgtcctttcgattataggacagctgcccgcgatgctattgctaaagccaacccggtagtgagggctgagaaacttgataaaatctaaaaagagtcgaggatgaagatgaaggtgaaggtgaagaattgtgtaatgaagtatggggtttatggtcctacccattgtgtcgtcagctcatcatagtgaaggtttatttaaagttgggtgctttgtctcattaggtgtcccctttgatttgatataaaaaacaagttggaaagtggatagggaggacaccattgcagtgtaaggaaagtctatattccttgtcaatttgttggcgatacatttaagttcgcccctgtttgtaagtctttgtttgtgctggtttgatggaacaatcgatatgatcgccttgtaatgcttcttttcatatgcacttctttcttctagtagcacc

SEQ ID NO: 1234 - protein, 169 aa, Gossypium hirsutum
  misc_feature: Ceres CLONE ID no.1843021
  misc_feature: Bit score of 173.5 for HMM based on sequences of FIGURE 15.
  misc_feature (110)..(150): Pfam Name: zf-AN1 Pfam Description: AN1-like Zinc finger
  misc_feature (15)..(39): Pfam Name: zf-A20 Pfam Description: A20-like zinc finger
  misc_feature: Functional Homolog Of Ceres SEEDLINE ID no. ME02401 at SEQ ID NO. 749
MDPHDETGRQASEGPILCVNNCGFFGSAATMNMCSKCHKAMILKQEQAQLVASSIDSIVNGSTSGNGKEPSVAAALAVQCGNFGSKIESSIDPSHMTFGGMKTKEGPNRCNACHKRVGLTGFSCRCGNIFCAAHRYSDKHNCPFDYRTAARDAIAKANPVVRAEKLDKI

SEQ ID NO: 1235 - DNA, 1006 bp, Gossypium hirsutum
  misc_feature: Ceres CLONE ID no.1931194
  misc_feature: Encodes the peptide sequence at SEQ ID NO. 1236
atttttaaaaaaatcctcctaaaaaagaaaaagaaaaaatcacccgcaatttctctttctcctatcagtttcgttacataatatatctcttcgattaaagaatcgctgggttcgattttgtcagacaagatcggccaaattaagatatcagagaagatggaccctcttgatgagacaggccgccaagcttcagaaggccccatcctgtgtgttaataactgtggtttctttggaagtgcggctaccatgaatatgtgctccaaatgtcacaaggcaatgatcctgaagcaggaacaggcacaactcgtagcatcatccatcgatagcattgttaatggcagcactagcgggaatggtaaggaaccatctgttgctgctgctttggctgtgcaatgtggaaattttgggtcaaaaattgaatcatccatcgatccatcccatatgaccttcggtgggatgaaaacaaaagagggtcccaacaggtgtaatgcatgccacaagcgtgttggtttgacaggatttagctgcaggtgtggaaacatcttctgtgcagcgcataggtactctgacaaacacaactgtcctttcgattataggacagccgcccgcgatgctattgctaaagccaatccggtagtgagggctgagaaacttgataaaatctaaaaagagtagaggatgaaggtgaaggtgaagaattgtgtaatgaagtatggggtttatggtcctacccattgtgtcgtcagctcatcatagtgaaggtttatttaaagttgggtgctttgtctcattaggtgtcccctttgatttgatataaaaaacaagttggaaagtggataatagggaggacaccattgcagtgtaaggaaagtctatattccttgtcaatttgttggcgatacatttaagttcgcccctgtttgtaagtctttgtttgtgctggtttgatggaacaatcgatatgatcgccttgtaatgcttcttttcatatgcacttctttcttcc

SEQ ID NO: 1236 - protein, 169 aa, Gossypium hirsutum
  misc_feature: Ceres CLONE ID no.1931194
  misc_feature: Bit score of 172.8 for HMM based on sequences of FIGURE 15.
  misc_feature (110)..(150): Pfam Name: zf-AN1 Pfam Description: AN1-like Zinc finger
  misc_feature (15)..(39): Pfam Name: zf-A20 Pfam Description: A20-like zinc finger
  misc_feature: Functional Homolog Of Ceres SEEDLINE ID no. ME02401 at SEQ ID NO. 749
MDPLDETGRQASEGPILCVNNCGFFGSAATMNMCSKCHKAMILKQEQAQLVASSIDSIVNGSTSGNGKEPSVAAALAVQCGNFGSKIESSIDPSHMTFGGMKTKEGPNRCNACHKRVGLTGFSCRCGNIFCAAHRYSDKHNCPFDYRTAARDAIAKANPVVRAEKLDKI

SEQ ID NO: 1237 - DNA, 622 bp, Panicum virgatum
  misc_feature: Ceres CLONE ID no.2025938
  misc_feature: Encodes the peptide sequence at SEQ ID NO. 885
ttgcctttgcccgctgcgcttgcgcgtccgcggaaggaaggggacgacgacgcgtccccgtctccccgattaaaagggcccgggcgcctctcgtccattcctcgctcctcgccgatcacagcagcgacctcctccccaatcccgatttcgcgagctcgtcccccgcctcccggcctctcccgtctccccgccccccgcccgccctccgagaagcgaagctccgggccgcgccaccgcgcaggcacacccaaggcagcaggcgcggttccttccaccaggtgcgcgggcggcggcatggcgcagcgcgacaagaaagaggagcccacggagctccgggcgccggagatcacgctctgcgccaacaactgcggcttcccggggaacccggccacgcagaacctctgccagagctgcttctcggcggccacggcgtcgatgtcgtcgccgacctcctcctcgtcctccccggctcccgcgccggccgcggcgccccagccgaggccggcgccggtggagctggcctccccggccgacgcggccgtggcggccccggctccggaggcggcgaggacgccggcgaaccggtgctcgagctgccggaagcgggtggggctcacggggt

SEQ ID NO: 1238 - protein, 172 aa, Panicum virgatum
  misc_feature: Ceres CLONE ID no.1783953
  misc_feature: Bit score of 361.3 for HMM based on sequences of FIGURE 15.
  misc_feature (98)..(138): Pfam Name: zf-AN1 Pfam Description: AN1-like Zinc finger
  misc_feature (18)..(42): Pfam Name: zf-A20 Pfam Description: A20-like Zinc finger
  misc_feature: Functional Homolog Of Ceres SEEDLINE ID no. ME02401 at SEQ ID NO. 749
MESHDETGCQAPEGPILCINNCGFFGSAATMNMCSKCHKAMILKQEQAQLAASSIGSIVNGSSTGNGKEPAVATALDVQSGNADTKMVSTELPIDPSGTTSCGMKMKEGPNRCTKCCKRVGLTGFNCRCGNLFCAAHRYSDKHDCPFDYRAAARNAIAKANPVVRAEKLDKI

SEQ ID NO: 1239 - DNA, 715 bp, Gossypium hirsutum
  misc_feature: Ceres CLONE ID no.1930044
  misc_feature: Encodes the peptide sequence at SEQ ID NO. 1240
aaaataaaatccaaaaagaaaaatcatacgatcaaagatcgtctttctcgtctggatttctccgattatcatacataaaactcttcgattaaggggattagagaagatggagtctcacgatgagacagggtgccaagccccagaaggccccattctttgtatcaacaactgtggcttcttcggcagtgcagctaccatgaatatgtgctccaagtgtcacaaagcgatgatcctgaagcaggaacaggcgcaacttgcagcatcatcaatcggaagcatcgtgaatggcagctcaactgggaacggtaaggaaccagccgtggctactgctttggatgtacaatctggaaacgccgacaccaaaatggtctcaacagagctacccattgacccatccggaacgacttcatgtgggatgaaaatgaaagagggtcctaacaggtgtaccaaatgctgtaaacgtgttggtttgacaggatttaactgcaggtgtggaaacctcttctgtgcagctcatcgttactccgacaaacatgactgccctttcgattaccgagctgctgctcgcaatgctattgctaaagccaacccagttgttcgggcagagaagctcgataaaatctgagaacaacccgggtcaagatgaagatatgtggatggtttatgttagttggttacttgtctcatcaagtgtccccttgattgatattaaatg

SEQ ID NO: 1240 - protein, 172 aa, Gossypium hirsutum; identical to SEQ ID NO: 1238
  misc_feature: Ceres CLONE ID no.1930044
  misc_feature: Bit score of 182.6 for HMM based on sequences of FIGURE 15.
  misc_feature (113)..(153): Pfam Name: zf-AN1 Pfam Description: AN1-like Zinc finger
  misc_feature (15)..(39): Pfam Name: zf-A20 Pfam Description: A20-like zinc finger
  misc_feature: Functional Homolog Of Ceres SEEDLINE ID no. ME02401 at SEQ ID NO. 749

SEQ ID NO: 1241 - DNA, 973 bp, Arabidopsis thaliana
  misc_feature: Ceres CLONE ID no.24255
  misc_feature: Encodes the peptide sequence at SEQ ID NO. 1242
aacacatctctctctctctctctctctttctctctttttatatttttgtgtcccaatctcttcttcatttctgtttggttgccgagaaaacgcaggaaacttttctgcaaaaaaactcggtgaccatatttaaaactttcccacgttaattctctcttctttgttttgtttcagattcattacttttctccaaaaaactttcttcaagatctgctcttttaaataattatggcggaagaacatcgatgcgagacgcctgaaggtcaccgtctctgcgttaacaactgcggtttcttcggaagctcagcgacaatgaatctatgttcaaactgttacggcgatctctgtctcaaacaacaacaacaagcttccatgaaatcaaccgtcgaatcatctctctctccggtgatcgcacctgttctcgaaaactacgcggcggagttagagatcccgacgacgaagaagacagaggagaaaaaaccgattcaaattccgacggagcaaccgtctccgccgcaacggccgaatcgatgcaccgtatgtaggaaacgggtcgggttaaccgggtttatgtgtcggtgcgggacgactttttgtgggagtcataggtatccggaggttcatggttgtacgtttgatttcaaatcggcgggacgtgaagagatcgcgaaagctaatccgttggttattgcggcgaagcttcagaaaatatgaatcggagccgttgaccgatttctatctttaccctgagaaaatttcgattgtctcggtggatctcagccgttcattatgttattgtattacggacacgtgtcgcaagattaaggttgagatggtttcgtaactttttaattattttctttgtttatttccgaagaaattaaagtttttatgattgtgtggcttttgcttgtaaaaaaaaaaagggtttctctttgggaaaaagaaaagaaaatatatgaaattgtgtccc

SEQ ID NO: 1242 - protein, 161 aa, Arabidopsis thaliana; identical to SEQ ID NO: 742
  misc_feature: Ceres CLONE ID no.24255
  misc_feature: Bit score of 382.2 for HMM based on sequences of FIGURE 7.
  misc_feature (102)..(142): Pfam Name: zf-AN1 Pfam Description: AN1-like Zinc finger
  misc_feature (13)..(37): Pfam Name: zf-A20 Pfam Description: A20-like zinc finger
  misc_feature: Functional Homolog Of Ceres SEEDLINE ID no. ME04477 at SEQ ID NO. 742

SEQ ID NO: 1243 - DNA, 543 bp, Sorghum bicolor
  misc_feature: Ceres ANNOT ID no.6034955
  misc_feature: Encodes the peptide sequence at SEQ ID NO. 1244
atggcgcagaagcgaaagagcatcgacgtcgtcgaggactgcggcggccacgcgcccgccgccaggcggtgtgcgaacgggtgcgggtacttcggcaacgccgcgaccggcggcatgtgctccaagtgctaccgcaagcacgccgccgccggcgccacggcgacgtctacctctaccaccaccgctgacaagaagacgacgacggcgcaggctgtttccgagacgccggcgccggcggagaagaaggccaagatcgcgtgcgccgtcgcgtcgtcgtcccctggcggcggcgtcgacaatgcaggcgcggcccgggctccgtccacggagccgcagccggtgaagcagactgcgaaccggtgctcggcgtgccgcaagaaagtgggcctgctggggttccggtgctgctgcggggaaaccttctgcggcgcgcaccggtacgcggagaagcacgcctgcggctacgactacaaaagcgccggccgcgagcggatcgccaagaacaacccggtcgtcgtcgccgacaagatcgccaagatttga

SEQ ID NO: 1244 - protein, 180 aa, Sorghum bicolor
  misc_feature: Ceres ANNOT ID no.6034955
  misc_feature: Bit score of 161.7 for HMM based on sequences of FIGURE 15.
  misc_feature (121)..(161): Pfam Name: zf-AN1 Pfam Description: AN1-like Zinc finger
  misc_feature (21)..(45): Pfam Name: zf-A20 Pfam Description: A20-like zinc finger
  misc_feature: Functional Homolog Of Ceres SEEDLINE ID no. ME02401 at SEQ ID NO. 749
MAQKRKSIDVVEDCGGHAPAARRCANGCGYFGNAATGGMCSKCYRKHAAAGATATSTSTTTADKKTTTAQAVSETPAPAEKKAKIACAVASSSPGGGVDNAGAARAPSTEPQPVKQTANRCSACRKKVGLLGFRCCCGETFCGAHRYAEKHACGYDYKSAGRERIAKNNPVVVADKIAKI

SEQ ID NO: 1245 - DNA, 453 bp, Sorghum bicolor
  misc_feature: Ceres ANNOT ID no.6119444
  misc_feature: Encodes the peptide sequence at SEQ ID NO. 1246
atggcggaggagcagcagcagcagcagcagcagaggtggcaggacggccaccgcctgtgcgccaacaactgcggcttcttcggcagccccgcgacgctggacctctgctccaagtgctaccgcgacctgtacccgcaggagcagcagcagccagcaccagcgggccccttcgttcctgccgcgtcggccttccatccttcctcctcgtcggtctctcccgagcccgagcctccggcggcctctgctgcaggcgccaaggccggcaggtgcgccagctgccggaagcgcgtgggcctgacggggttcgcgtgccgctgcggcgccaccttctgcggcgtgcaccggtacccggagcggcacgcgtgcgccttcgacttccgcgccgccggccgcgacgccatcgcgcgcgccaaccccgtcgtcaagggcgacaagctcaaggacaagatctga

SEQ ID NO: 1246 - protein, 150 aa, Sorghum bicolor
  misc_feature: Ceres ANNOT ID no.6119444
  misc_feature: Bit score of 139.1 for HMM based on sequences of FIGURE 15.
  misc_feature (17)..(41): Pfam Name: zf-A20 Pfam Description: A20-like zinc finger
  misc_feature (90)..(130): Pfam Name: zf-AN1 Pfam Description: AN1-like Zinc finger
  misc_feature: Functional Homolog Of Ceres SEEDLINE ID no. ME02401 at SEQ ID NO. 749
MAEEQQQQQQQRWQDGHRLCANNCGFFGSPATLDLCSKCYRDLYPQEQQQPAPAGPFVPAASAFHPSSSSVSPEPEPPAASAAGAKAGRCASCRKRVGLTGFACRCGATFCGVHRYPERHACAFDFRAAGRDAIARANPVVKGDKLKDKI

SEQ ID NO: 1247 - DNA, 600 bp, Sorghum bicolor
  misc_feature: Ceres ANNOT ID no.6063956
  misc_feature: Encodes the peptide sequence at SEQ ID NO. 1248
atggcggagaggcaggaggtcatctccggcgtcggtgcggcagcggcaccgatgtgcgccaacggctgcgggttcttcgggagcgcggcgaccaacaacttctgctcaacgtgctacaagcaggatcacctgatgatcaccaagaccgccggcgccggcgccgctcccctggaagcgtccggccgccgcggcctcatcgagtgcgccaacgcgtgcggttacttcgggtacccagcgaccaacaacctgtgcaccctctgctacagggacttcctcgaaagcgttcactcctcccctgccgcggcggacaaggtcgtcgtcctcgctgccgagcagccggcggcggcccagatctctgctgcaacttctagtgctacacgggcggtggaggcggcggcggcggcggcgtcgagcaggtgcgcgtcgtgccgcaagaaggtggggctgctggggtttccctgccgctgtggcggcacgttctgcgcgctgcaccggtacgcggagaagcacgcctgcggcttcgacttcaaggcggcgggccgggagaagatcgccaagaacaacccgctcgtcgtggccgccaagatcaacaagatctga

SEQ ID NO: 1248 - protein, 199 aa, Sorghum bicolor
  misc_feature: Ceres ANNOT ID no.6063956
  misc_feature: Bit score of 133.6 for HMM based on sequences of FIGURE 15.
  misc_feature (140)..(180): Pfam Name: zf-AN1 Pfam Description: AN1-like Zinc finger
  misc_feature (16)..(40): Pfam Name: zf-A20 Pfam Description: A20-like zinc finger
  misc_feature: Functional Homolog Of Ceres SEEDLINE ID no. ME02401 at SEQ ID NO. 749
MAERQEVISGVGAAAAPMCANGCGFFGSAATNNFCSTCYKQDHLMITKTAGAGAAPLEASGRRGLIECANACGYFGYPATNNLCTLCYRDFLESVHSSPAAADKVVVLAAEQPAAAQISAATSSATRAVEAAAAAASSRCASCRKKVGLLGFPCRCGGTFCALHRYAEKHACGFDFKAAGREKIAKNNPLVVAAKINKI

SEQ ID NO: 1249 - DNA, 570 bp, Sorghum bicolor
  misc_feature: Ceres ANNOT ID no.6015461
  misc_feature: Encodes the peptide sequence at SEQ ID NO. 1250
atgtcgcggcagcagataggtggcggtggcagcgccacgccgatgtgcgccgcgggctgcggtttctttgggagcccggcgaccctcggcatgtgctccgtctgctacaagaagcactgctgcaccattacggacggtccaggcgcctcctacgccgcaacggcgatcgatcccgtcgtcacccgatccaccgctaccgcggtgacccccgggcccggcgccgccgcggctaagccaacggtggtggccgcgcgcacgcccgccgcgagcgtctgtttgttggctcctgctgctaaaggcgccgtagcggaggccgccgccgtgtcgccgccccacgctcccgaggcggcggcgaagaagaagaaggcgccgccaccgggccggtgcgcggcgtgctgcaagaaggtggggctcacggggttcgtgtgccgatgcgggaacacgttctgcgggagccaccggtacgcggaggagcacggctgcagcttcgacttcaagggcgccagccgtgacgccatcgcccgcgccaacccggtcatcaaggcggagaagctgaccggcaagatctga

SEQ ID NO: 1250 - protein, 189 aa, Sorghum bicolor
  misc_feature: Ceres ANNOT ID no.6015461
  misc_feature: Bit score of 109.3 for HMM based on sequences of FIGURE 15.
  misc_feature (129)..(169): Pfam Name: zf-AN1 Pfam Description: AN1-like Zinc finger
  misc_feature (13)..(37): Pfam Name: zf-A20 Pfam Description: A20-like zinc finger
  misc_feature: Functional Homolog Of Ceres SEEDLINE ID no. ME02401 at SEQ ID NO. 749
MSRQQIGGGGSATPMCAAGCGFFGSPATLGMCSVCYKKHCCTITDGPGASYAATAIDPVVTRSTATAVTPGPGAAAAKPTVVAARTPAASVCLLAPAAKGAVAEAAAVSPPHAPEAAAKKKKAPPPGRCAACCKKVGLTGFVCRCGNTFCGSHRYAEEHGCSFDFKGASRDAIARANPVIKAEKLTGKI

SEQ ID NO: 1251 - DNA, 1324 bp, Triticum aestivum
  misc_feature: Ceres CLONE ID no.696244
  misc_feature: Encodes the peptide sequence at SEQ ID NO. 1252
atgcgcaacgccggctgttgaatattcttgctctatataaagggtccgttgctctgcatatggtgtacaagaacagagagggacagacacatttaacccaaggaccacgtacttccctagcttcttcccacgttgagctgagcgatggaccgacaagttcccgctacagatccttggtggtaccccggcgaggccgcagcatccaccggcgacgacgacttcctcgacattgaaggtctactcgggttggcgtgggaaggaggcacggctcttcccggcgtcggctctccgccaccggcgctggggccaccgtgcgcgtcgcctccagagccaacaccttccgaagacgtgatggcagcgtggctctacccgatcgtcagtggcgaggacaatgccggggacggccccatggtgaagggcaaaccgtcggccaaggcgtcggggagtttggggatgacggagagcgaggggaatcttccggctacggacggcatgtaccatgtcaaggagagctgtgatctcaacaaggacgaggccgagatcctgaagccatcctcctccacaccttcgcctccttccccaaccacaccaccaccaccaaccgctcaaataccagaaccgcaacctccacagtcgccaccacaaccaccggcagctcaattcttgtccaggccctgtgaagttgttcacatagagacttccaaaaagaggaaacatgctgatgcggtgtcaatggccatggcggctgcgccattgtcgcctgtgctgtttgttaaccgttgcaacgtgtgccgcaagagagttggtttgaccgggtttcgttgccggtgcgagaagctcttttgtccgcgccaccggcattcagaaagccacgactgctcatttgattataaaactgcgggccgggaggagattgcccgggcaaaccctcttatcagggctgccaagatcattaggatatgaggttcatctaagaattatatgaaagacttaaatcttggagatgctgcaagtgtatcatgctgtcattccaaggatgatccgaaagcatgaccactgccaacttgtgaagacattccccaaacaactaagctcttagtagcatacaagcctacattgagcaagagttggttgttgtgggagaatgcttcactcttgttcttcgtctggctatggttcactctatagcatctgaagctaccatgaacacagatgatagaacctatagtgtccagttgtaattctgttggatccaaagatttgttatattgtaatctttctttactattgttcaaattctacttaatgcaattgtgtgttactc

SEQ ID NO: 1252 - protein, 156 aa, Triticum aestivum
  misc_feature: Ceres CLONE ID no.696244
  misc_feature: Bit score of 105.4 for HMM based on sequences of FIGURE 15.
  misc_feature (97)..(137): Pfam Name: zf-AN1 Pfam Description: AN1-like Zinc finger
  misc_feature (18)..(42): Pfam Name: zf-AN1 Pfam Description: AN1-like Zinc finger
  misc_feature: Functional Homolog Of Ceres SEEDLINE ID no. ME02401 at SEQ ID NO. 749
MYHVKESCDLNKDEAEILKPSSSTPSPPSPTTPPPPTAQIPEPQPPQSPPQPPAAQFLSRPCEVVHIETSKKRKHADAVSMAMAAAPLSPVLFVNRCNVCRKRVGLTGFRCRCEKLFCPRHRHSESHDCSFDYKTAGREEIARANPLIRAAKIIRI

SEQ ID NO: 1253 - DNA, 444 bp, Populus balsamifera subsp. trichocarpa
  misc_feature: Ceres ANNOT ID no.1468973
  misc_feature: Encodes the peptide sequence at SEQ ID NO. 1254
atggactcgataaacagctcaactcttcctttgtgtgccaagggttgcgggttctttggttctccagagaacgagaatttttgttcaaagtgttataaagagtatctcaaagaagggttaattgctgagccttccaagaaactctctgaacctatcgtagtcaccccatcttttgatgataatagcccagatgttgttaccgacgaaacaacttcaacaactactgctgttgcatccacttcaaaagtgaagaatagatgtgaatgctgcaacaagaaagttggtttgatggggttcgagtgccgctgtgggaacaccttctgtggggttcatcgatatcctaaggagcactcttgtacttttgatttcaagactcttgatcaacaaaatttggccaagcaaaatccacttgttgcaggtgataaacttggttccagaatttga

SEQ ID NO: 1254 - protein, 147 aa, Populus balsamifera subsp. trichocarpa
  misc_feature: Ceres ANNOT ID no.1468973
  misc_feature: Bit score of 84.4 for HMM based on sequences of FIGURE 15.
  misc_feature (87)..(127): Pfam Name: zf-AN1 Pfam Description: AN1-like Zinc finger
  misc_feature (9)..(33): Pfam Name: zf-A20 Pfam Description: A20-like zinc finger
  misc_feature: Functional Homolog Of Ceres SEEDLINE ID no. ME02401 at SEQ ID NO. 749
MDSINSSTLPLCAKGCGFFGSPENENFCSKCYKEYLKEGLIAEPSKKLSEPIVVTPSFDDNSPDVVTDETTSTTTAVASTSKVKNRCECCNKKVGLMGFECRCGNTFCGVHRYPKEHSCTFDFKTLDQQNLAKQNPLVAGDKLGSRI

SEQ ID NO: 1255 - DNA, 642 bp, Panicum virgatum
  misc_feature: Ceres CLONE ID no.2019529
  misc_feature: Encodes the peptide sequence at SEQ ID NO. 1256
gccttcgcctacctctcgacgcccaaccccaaaaagaaaaattctcctcgcggagaaaggtcgcgtgccgtctcgcccacagttccgggcactgattgcttcgcctgtatgctgctggttgcctgccttgtgctgctactacatatgcaatctgtggagcaaccaaaaagaccttggcttcatgctatgattgtgtaaagcaattgactaaccaagcccatctgtaacaatggcacaggagagctggaaacaggaatctgaggagactggagtccatgcacctgaggccccaattctgtgcataaacaactgtggtttcttcggcagcagcatgacgaacaatatgtgctcgaagtgctacagggacttcatcaaattgatggaaggccctgtggttgagaagaaggtgatcacggtggcatcttcttctgcggcaccaatggagacagcaaagcaagatgatgtgcctgcagctgctgccactgaagctgtgacggagaagcaagcagagcaggagccgccaaagccgcccagcaaccggtgccttacctgccgcaagaaggttgggctgactggcttcctctgccgctgcgggggcaccttctgctccatgcaccgctacactgactcccaccagtgcac

SEQ ID NO: 1256 - protein, 137 aa, Panicum virgatum
  misc_feature: Ceres CLONE ID no.2019529
  misc_feature: Bit score of 94.2 for HMM based on sequences of FIGURE 15.
  misc_feature (105)..(137): Pfam Name: zf-AN1 Pfam Description: AN1-like Zinc finger
  misc_feature (21)..(45): Pfam Name: zf-A20 Pfam Description: A20-like zinc finger
  misc_feature: Functional Homolog Of Ceres SEEDLINE ID no. ME02401 at SEQ ID NO. 749
MAQESWKQESEETGVHAPEAPILCINNCGFFGSSMTNNMCSKCYRDFIKLMEGPVVEKKVITVASSSAAPMETAKQDDVPAAAATEAVTEKQAEQEPPKPPSNRCLTCRKKVGLTGFLCRCGGTFCSMHRYTDSHQC

SEQ ID NO: 1257 - DNA, 626 bp, Zea mays
  misc_feature: Ceres CLONE ID no.1492169
  misc_feature: Encodes the peptide sequence at SEQ ID NO. 1258
gctcgctccctccctccctccctcccgcgcggatcacagaagggctcacggtcacggccggcctcccaattcgcaacctcgcctccgcctctcctcctaccccctccgaaaagcaagctccggccgggccgccaccaccaccaccgcgcgcgcgtgcacgcgctcccacacacagacagacagacagacagacagagtgagagacgcacggtggttcggggtctcccttctgccaggcgcacgaggagccatggcgcagcgcgacaagaaggaggagcccacggagctccgggcgccggagatcacgctgtgcgccaacaactgcgggttcccgggtaacccggccacgcagaacctgtgccagagctgcttctcggcgtcgaggtcgccgtcgtcccctacctcctcctcctcttccctggcgtccgcggcgtcgcagccgaggccagcagcgctcgtcgtagacgcggcagcggtggaggcgctggccgctccggcggccgcggccgcgggccagggccaggctacggaagccgcggcgagggcgtccgcgagccggtgctccagctgccggaagcgcgtggggctgacggggttccggtgccgctgcggcgagctcttctgcg

SEQ ID NO: 1258 - protein, 125 aa, Zea mays
  misc_feature: Ceres CLONE ID no.1492169
  misc_feature: Bit score of 142.8 for HMM based on sequences of FIGURE 15.
  misc_feature (104)..(125): Pfam Name: zf-AN1 Pfam Description: AN1-like Zinc finger
  misc_feature (18)..(42): Pfam Name: zf-A20 Pfam Description: A20-like zinc finger
  misc_feature: Functional Homolog Of Ceres SEEDLINE ID no. ME02401 at SEQ ID NO. 749
MAQRDKKEEPTELRAPEITLCANNCGFPGNPATQNLCQSCFSASRSPSSPTSSSSSLASAASQPRPAALVVDAAAVEALAAPAAAAAGQGQATEAAARASASRCSSCRKRVGLTGFRCRCGELFC

SEQ ID NO: 1259 - DNA, 449 bp, Glycine max
  misc_feature: Ceres CLONE ID no.1652996
  misc_feature: Encodes the peptide sequence at SEQ ID NO. 1238
aaacaacccctttctcttctcttccaattacaaatcccttcttctctctctctctctttattctcatttcacaactcatcaatcccctctctctctctcccaaacgcaaaacctaagcatggctcagaaggcccagaaaaacgacactgagtttaaggtccccgaacccatcatcaacccctgcaccaccaccaccaccaccaccacctcgatttccgaaccttctagattcttcgatgcaaccacccccgccacttcatcgcgctccccaaagcgatccctccctctcgacgaggaatctcagacggaccaaacgacgtcttctgagcccaaacgcgccgtgaaccgctgctccggctgccggcggcgcgtgggactcacgggattccggtgccgctgcggggaccttttctgcgcagagcaccgctactccgaccgccacgactgct

SEQ ID NO: 1260 - DNA, 1096 bp, Oryza sativa subsp. japonica
  misc_feature: Ceres SEEDLINE ID no.ME18396
  misc_feature: Encodes the peptide sequence at SEQ ID NO. 1012
cttgaacagaatattaagttgatcactttaaaatatctttccttggctatatatcctgaaaagctcacccatggcaactgtttctgcggtctcagctcctattagaaggcttgaggggaaagtggcgattatcactggtggtgcaagcggcataggtgaggccactgcaagactcttctctaagcacggagcacaccttgtcatagctgacattcaagacgatttgggcctctctctttgcaaacacttggaatccgcttcctatgttcactgcgacgtgacaaaggaagaggacgttgaaaactgcgtgaacacagcggtttccaagtatggaaaactagacatcatgcttaataacgcaggtatatgtgatgagatcaaaacaagcatactagacaacaacaagtctgattttgagagtgtcataagcgtgaacttggttggtccttttctgggaacaaagcacgctgcaagagtcatgatcgctgctaaaaggggaagcataattaacacagctagtgttgctggaatcttaggtggagtggctacacatgcctacacaagttcaaagcacgcgctaattggactgatgaaaagcactgcggtggagcttggacagtttggtattcgggtgaattgtgtgtccccttatgtggttcccacaccgttgaccaagaaacatgccaatattgacgaagaaggagttcgtgagatttattccaacctaaaaggtgttcatcttgtgccgaacgatgtggccgaagctgctctttacttggcaggtgatgagtctaagtatgttagtggtcacaatctcgtgttagatggtgggtttactaatgtaaatataggattttctgtgtttggacagtcggagtaaaaattgtatgtatgtctttaaataatttttgttggtgcgggtttgaagtgttaatttgtattgaggtacacatcaatcttgctttttagatttgctgaacttgaaattatgaccatcaagaacataaattatctcttcatggacatcccatcgaaaagattgtatcgtgttaggatgaccaaccaattaaagtatgctttcgatcttgaccaaatg

SEQ ID NO: 1261 - DNA, 669 bp, Sorghum bicolor
  misc_feature: Ceres Annot ID no. 8703793
  misc_feature: Encodes the peptide sequence at SEQ ID NO. 1262
atggcgatcgtctacgccctggtcgctcggggcacggtggttctggccgagttcgccgccgtctcaggcaacgccggcgccgtggcccgccggatcctcgagaagctgccgcccgacgccgagtccaggctgtgctttgcgcaggaccggtacatcttccacgtcctccggtctgacgccgccggcatcaccttcctctgtatggccaacgacaccttcggaagaagaatcccctttctctacctggaggacatccaaatgaggttcatgaaaaactacggcagagtcgcccactctgcgctggcttacgccatgaacgatgaattctccagggtgctccatcagcaaatggagttcttctccagcaacccaagtgctgacacactcaaccgtctccgcggagaagtcagtgagatacacaccgtcatggtcgacaacattgagaaaattcttgacagaggcgaccgcatctcgctccttgtggacaagacatccaccatgcaggacagctcctttcacttccgcaagcaatccaagaggctccgcagagctctttggatgaagaatgccaagcttctagttgtgttgacagttgtcatagtagtgctgctctacttgatcatttctgctttctgtggaggcctttccttatcatcatgcagatcatga

SEQ ID NO: 1262 - protein, 222 aa, Sorghum bicolor
  misc_feature: Ceres Annot ID no. 8703793
  misc_feature (1)..(222): Bit score of 583.0 for hmm based on sequences of FIGURE 13.
  misc_feature (125)..(213): Pfam Name: Synaptobrevin Pfam Description: Synaptobrevin
  misc_feature: Functional Homolog Of SEQ ID NO. 160
MAIVYALVARGTVVLAEFAAVSGNAGAVARRILEKLPPDAESRLCFAQDRYIFHVLRSDAAGITFLCMANDTFGRRIPFLYLEDIQMRFMKNYGRVAHSALAYAMNDEFSRVLHQQMEFFSSNPSADTLNRLRGEVSEIHTVMVDNIEKILDRGDRISLLVDKTSTMQDSSFHFRKQSKRLRRALWMKNAKLLVVLTVVIVVLLYLIISAFCGGLSLSSCRS

SEQ ID NO: 1263 - DNA, 663 bp, Sorghum bicolor
  misc_feature: Ceres Annot ID no. 8632125
  misc_feature: Encodes the peptide sequence at SEQ ID NO. 1264
atggggcagcagtcgctgatctacgcgttcgtggcccgtggcacggtcatactggccgagtacacggagttcaccggcaacttcaccaccatcgcctcccagtgcctcatgaagctccccgcaagcaacaacaagttcacctacaactgcgatggccacaccttcaattacctcgtggaagacggattcacatactgtgttgttgctgttgaatcagtggggcaacaaattcccattgctttcatggatagggttaaggaggatttcacaaaaaggtatggtggtgggaaagctgctactgctgcagctaacagcctcaaccgagagttcggatcaaaacttaaagagcacatgcagtattgtgtggatcaccctgaagaggttagcaagctggccaaagtgaaggcacaggtttcagaagtcaagggtgttatgatggagaacattgaaaaggttctagatcgtggagagaagattgagctgcttgttgacaagaccgagaatttgcgctcacaggcccaaaatttccggcagcaaggaacaaatgtgaggagaaagatgtggttacagaacatgaaaatcaagcttatcggcctgggaataataattgcacttattctgatcattatcctctctgtctgtcacggtttcaagtgccattaa

SEQ ID NO: 1264 - protein, 220 aa, Sorghum bicolor
  misc_feature: Ceres Annot ID no. 8632125
  misc_feature (1)..(220): Bit score of 171.2 for hmm based on sequences of FIGURE 13.
  misc_feature (127)..(215): Pfam Name: Synaptobrevin Pfam Description: Synaptobrevin
  misc_feature: Functional Homolog Of SEQ ID NO. 160
MGQQSLIYAFVARGTVILAEYTEFTGNFTTIASQCLMKLPASNNKFTYNCDGHTFNYLVEDGFTYCVVAVESVGQQIPIAFMDRVKEDFTKRYGGGKAATAAANSLNREFGSKLKEHMQYCVDHPEEVSKLAKVKAQVSEVKGVMMENIEKVLDRGEKIELLVDKTENLRSQAQNFRQQGTNVRRKMWLQNMKIKLIGLGIIIALILIIILSVCHGFKCH

SEQ ID NO: 1265 - protein, 226 aa, Zea mays
  misc_feature: Public GI ID no. 194699974
  misc_feature (1)..(226): Bit score of 541.8 for hmm based on sequences of FIGURE 13.
  misc_feature (129)..(217): Pfam Name: Synaptobrevin Pfam Description: Synaptobrevin
  misc_feature: Functional Homolog Of SEQ ID NO. 160
MGKIEYGVVARGAVVLAEHYGAAAAGGNAGAVARQVLERLPGGGDDDCNVSYTQDLHVFHVKRTDGLTALCMADDAAGRRVPFAFLEDIHGRFVKAYGRAALTALAYAMNDEFSRVLAQQMDYYSNDASADRINRMRGEMDQVRSVMMDNIDRVLERGDRLEVLVDKTATMQGNTMRFKRQARRFRNTMWWRNVKLTAAVIFILTVIVYVLLAYMCRGFTIPSCFP

SEQ ID NO: 1266 - DNA, 1008 bp, Zea mays
  misc_feature: Ceres Clone ID no. 100736041
  misc_feature: Encodes the peptide sequence at SEQ ID NO. 1267
ctacctcttcgctcccggctcccctccatctctttcgccacacgcgcgagaggggggagaggaaacagctagcagcgagcgaggaacgaagagggtgcttcgcacgtgcatgtgagatcgggcgatcccgatcgtcggccggcgcgaactaacgacgacgtacgtgcgaccgggccgggcgttgtaggacggcgcgcgcgatgggcaagatcgagtacggcgtggtggcgcgcggcgcggtggtgctggcggagcactacggcgcggcggcggcgggcggcaacgcgggcgccgtggcgcggcaggtcctggagcgcctccctggcggcggcgacgacgactgcaacgtgtcgtacacgcaggacctccacgtgttccacgtcaagcgcaccgacggcctcacggcgctctgcatggccgacgacgccgccgggcggcgtgtccccttcgcgttcctggaggacatccacgggaggttcgtcaaggcgtacggccgcgcggcgctcaccgcgctggcgtacgccatgaacgacgagttctcccgcgttctggcccagcagatggactactactccaacgacgccagcgcggacaggataaatcgcatgaggggagagatggaccaggtccggagcgtgatgatggacaacatcgacagggtgctggagaggggtgaccgtctggaggtgctggtggacaagacggcaaccatgcaggggaacacgatgcgcttcaagcgccaagctcgccgcttcaggaacaccatgtggtggaggaacgtcaagctcacagctgcagtgatattcatcctccccgtaattgtgtacgtcctgctcgcctacatgtgtcgcggcttcaccataccgtcatgctttccgtaatctccatccgtcccggtgccagtgcggacccccagccctagctctagctgcatcacaacttggttttccgggttctgtaacagcagcagcggtgctgcagttcttttttttttgtacgagggaaaca

SEQ ID NO: 1267 - protein, 226 aa, Zea mays
  misc_feature: Ceres Clone ID no. 100736041
  misc_feature (1)..(226): Bit score of 539.7 for hmm based on sequences of FIGURE 13.
  misc_feature (129)..(217): Pfam Name: Synaptobrevin Pfam Description: Synaptobrevin
  misc_feature: Functional Homolog Of SEQ ID NO. 160
MGKIEYGVVARGAVVLAEHYGAAAAGGNAGAVARQVLERLPGGGDDDCNVSYTQDLHVFHVKRTDGLTALCMADDAAGRRVPFAFLEDIHGRFVKAYGRAALTALAYAMNDEFSRVLAQQMDYYSNDASADRINRMRGEMDQVRSVMMDNIDRVLERGDRLEVLVDKTATMQGNTMRFKRQARRFRNTMWWRNVKLTAAVIFILPVIVYVLLAYMCRGFTIPSCFP

SEQ ID NO: 1268 - DNA, 740 bp, Zea mays
  misc_feature: Ceres Clone ID no. 100932667
  misc_feature: Encodes the peptide sequence at SEQ ID NO. 1269
ccgcggcgccgctccgctcgaaatccccaaaaaggcaagatcaaatcaaatcagatctctccacccccagcccatccatggcgatcgtgtacgccctggtcgcgcggggcacggtggtgctggccgagttcgccgccgtctcgggcaacgccggcgccgtggcccgtcggatcctcgagaagctgccgcccgacgccgagtccaggctgtgcttcgcgcaggaccggtacatcttccacgtcctccgatccgacgccgccggcatcaccttcctctgtatggccaacgacaccttcggaagaaggatcccctttctctacctggaggacatccaaatgaggttcatgaaaaactacggcagagtcgcccactctgcgctggcttacgccatgaacgatgagttctccagagtgctccatcagcaaatggagttcttctccagcaacccaagcgccgacacactcaaccgtctccgtggagaagtcagcgagatacacaccgtcatggtcgacaacatagagaaaattcttgacagaggcgatcgcatctcgctccttgtcgacaagacatccaccatgcaagacagcgcctttcacttccgcaagcaatccaagaggctccgtagagctctttggatgaagaatgccaagcttctagttgtgttgacagttgtcatagtagtgctgctctacttgatcatttctgctttctgtggaggcctttccttgtcatcatgcaga

SEQ ID NO: 1269 - protein, 221 aa, Zea mays
  misc_feature: Ceres Clone ID no. 100932667
  misc_feature (1)..(221): Bit score of 580.4 for hmm based on sequences of FIGURE 13.
  misc_feature (125)..(213): Pfam Name: Synaptobrevin Pfam Description: Synaptobrevin
  misc_feature: Functional Homolog Of SEQ ID NO. 160
MAIVYALVARGTVVLAEFAAVSGNAGAVARRILEKLPPDAESRLCFAQDRYIFHVLRSDAAGITFLCMANDTFGRRIPFLYLEDIQMRFMKNYGRVAHSALAYAMNDEFSRVLHQQMEFFSSNPSADTLNRLRGEVSEIHTVMVDNIEKILDRGDRISLLVDKTSTMQDSAFHFRKQSKRLRRALWMKNAKLLVVLTVVIVVLLYLIISAFCGGLSLSSCR

SEQ ID NO: 1270 - DNA, 1134 bp, Zea mays
  misc_feature: Ceres Clone ID no. 228789
  misc_feature: Encodes the peptide sequence at SEQ ID NO. 1271
gtacccgaattccatttcttcctcccctttttcctttccacgccttcccaccactcccagaggacccagacagacccctttcccctccctcctcgaccactccgacgcccacagcgcctccggcgagctccacctctccaccggcggcagcgaggggcgaggggggctaatactgtaggcggaggaggaaccgagccgatggggcagcagtcgctgatctacgcgttcgtggcgcggggcaccgtggtgctggccgagtacaccgagttcaccggcaacttcaccaccatcgccgcccagtgcctgcagaagctccccgccagcaacaacaagttcacctacaactgcgacggccacaccttcaactacctcgtcgaggacggattcacgtactgtgtagttgctgttgaatcagtcgggcgacaaatccccatagctttcctggacagagttaaggaagacttcaccaaaaagtatggaggcgggaaagcagctactgctgcagcgaacagcttgaagagggagtttggaccaaagcttaaagagcacatgcagtactgtgtggaccaccctgaggaggttagcaagcttgctaaggtgaaggcccaagtctctgaagtcaaaggagttatgatggaaaacattgagaaggttcttgaccgtggtgagaagattgagctgctagttgacaaaactgaaaatctgcgttctcaggcacaggatttcagacagcagggcaccaacgtgcggcgaaagatgtggctccaaaacatgaagatcaagctgatcgtcctgggcatcatcatcgcgctgatcctcatcatcatcctgtcggtgtgccacggcttcaagtgcggcagcaagtgaggaggggggcgtgacttacagatggctggtgtgccctggcaccggcgaggagaaagaccatggggagttttgctctttttggtcgtcttgttgttgagtcctgcgctgattattcttggtgatcgtcagagggagttattcctgatgtcggtgttgattgctgttggttgggaagtgacggtgaaccgggggaaggggggagggggttgtgtcgtgtaattttggatgctactgttgtgcatgtatagcttgtctgctaccctgttc

SEQ ID NO: 1271 - protein, 222 aa, Zea mays
  misc_feature: Ceres Clone ID no. 228789
  misc_feature (1)..(222): Bit score of 180.2 for hmm based on sequences of FIGURE 13.
  misc_feature (127)..(215): Pfam Name: Synaptobrevin Pfam Description: Synaptobrevin
  misc_feature: Functional Homolog Of SEQ ID NO. 160
MGQQSLIYAFVARGTVVLAEYTEFTGNFTTIAAQCLQKLPASNNKFTYNCDGHTFNYLVEDGFTYCVVAVESVGRQIPIAFLDRVKEDFTKKYGGGKAATAAANSLKREFGPKLKEHMQYCVDHPEEVSKLAKVKAQVSEVKGVMMENIEKVLDRGEKIELLVDKTENLRSQAQDFRQQGTNVRRKMWLQNMKIKLIVLGIIIALILIIILSVCHGFKCGSK

SEQ ID NO: 1272 - DNA, 1136 bp, Zea mays
  misc_feature: Ceres Clone ID no. 246664
  misc_feature: Encodes the peptide sequence at SEQ ID NO. 1273
attacccctcctcccactccacggagaagcgaaaccgacctttccccctcccccgcattccacctcgcggagatccagtccagccctagggtttcgccagcggcgagccaaactccacgagcgggggaagaggggaaagcagggacgacgagggggcagccatggggcagcagtcgctgatctacgcgttcgtggcccgtggcacggtcatactggccgagtacacggagttcaccggcaacttcaccaccatcgcctcccagtgcctcatgaagctccccgcaagcaacaacaagttcacctacaactgcgacggtcacactttcaattacctcgtggaagacggattcacatactgtgttgttgctgttgaatcggtggggcaacaaattcctattgctttcatggatagggttaaggaggatttcacaaaaaggtatggtggtgggaaagctgctactgctgcagctaacagcctcaatcgagagtttggatcaaaacttaaagaacacatgcagtattgtgtggatcaccctgaagaggttagcaagctggccaaagtgaaggcgcaggtttcagaagtcaagggtgttatgatggaaaacattgaaaaggttctggatcgtggagagaagattgagctgcttgtcgacaagaccgagaatcttcgctcacaggcacaagatttcagacagcagggaacaaatgtcaggagaaagatgtggttacagaacatgaaaatcaagctcatcgtcctgggaataatcatcgcactcattctgatcattatcctctctgtctgtcatggtttcaaatgccattaagcacagaccagaatactgatacattcaactgcacctattatactgctgcttggagcaaaaaaaagtatgatcttttgttgtttcgctagtgtgctgtggcccggtcattatgcataggtgttttacattgtcgtagtgtttgataaatgatggatggtgactgggtttgttgtgtcaactgtcataactattgtgcatttttggacgctatatgtgtagccttgatatgaatagatttactgtacttataagggctggtgtgactcagccgtttgctcctttgggcaatgtgcgcatttgggagcatcttgc

SEQ ID NO: 1273 - protein, 220 aa, Zea mays
  misc_feature: Ceres Clone ID no. 246664
  misc_feature (1)..(220): Bit score of 173.2 for hmm based on sequences of FIGURE 13.
  misc_feature (127)..(215): Pfam Name: Synaptobrevin Pfam Description: Synaptobrevin
  misc_feature: Functional Homolog Of SEQ ID NO. 160
MGQQSLIYAFVARGTVILAEYTEFTGNFTTIASQCLMKLPASNNKFTYNCDGHTFNYLVEDGFTYCVVAVESVGQQIPIAFMDRVKEDFTKRYGGGKAATAAANSLNREFGSKLKEHMQYCVDHPEEVSKLAKVKAQVSEVKGVMMENIEKVLDRGEKIELLVDKTENLRSQAQDFRQQGTNVRRKMWLQNMKIKLIVLGIIIALILIIILSVCHGFKCH

SEQ ID NO: 1274 - protein, 220 aa, Zea mays; identical to SEQ ID NO: 1273
  misc_feature: Public GI ID no. 194699710
  misc_feature (1)..(220): Bit score of 173.2 for hmm based on sequences of FIGURE 13.
  misc_feature (127)..(215): Pfam Name: Synaptobrevin Pfam Description: Synaptobrevin
  misc_feature: Functional Homolog Of SEQ ID NO. 160

SEQ ID NO: 1275 - DNA, 789 bp, Zea mays
  misc_feature: Ceres Clone ID no. 101142725
  misc_feature: Encodes the peptide sequence at SEQ ID NO. 1276
  misc_feature (17)..(17): n is a, c, t, g, unknown, or other
cccacgccgtccggggnaaagcagagacgacgagggggcagccatggggcagcagtcgctgatctacgcgttcgtggcccgtggcacggtcatactggccgagtacacggagttcaccggcaacttcaccaccatcgcctcccagtgcctcatgaagctccccgcaagcaacaacaagttcacctacaactgcgacggtcacactttcaattacctcgtggaagacggattcacatactgtgttgttgctgttgaatcggtggggcaacaaattcctattgctttcatggatagggttaaggaggatttcacaaaaaggtatggtggtgtgaaagctgctactgctgcagctaacagcctcaatcgagagtttggatcaaaacttaaagaacacatgcagtattgtgtggatcaccctgaagaggttagcaagctggccaaagtgaaggcgcaggtttcagaagtcaagggtgttatgatggaaaacattgaaaaggttctggatcgtggagagaagattgagctgcttgtcgacaagaccgagaatcttcgctcacaggcacaagatttcagacagcagggaacaaatgtcaggagaaagatgtggttacagaacatgaaaatcaagctcatcgtcctgggaataatcatcgcactcattctgatcattatcctctctgtctgtcatggtttcaaatgccattaagcacagaccagaatactgatacattcaactgcaccctattatactgctgcttggagcaaaaaagtatgatctttttgtgtttc

SEQ ID NO: 1276 - protein, 220 aa, Zea mays
  misc_feature: Ceres Clone ID no. 101142725
  misc_feature (1)..(220): Bit score of 176.1 for hmm based on sequences of FIGURE 13.
  misc_feature (127)..(215): Pfam Name: Synaptobrevin Pfam Description: Synaptobrevin
  misc_feature: Functional Homolog Of SEQ ID NO. 160
MGQQSLIYAFVARGTVILAEYTEFTGNFTTIASQCLMKLPASNNKFTYNCDGHTFNYLVEDGFTYCVVAVESVGQQIPIAFMDRVKEDFTKRYGGVKAATAAANSLNREFGSKLKEHMQYCVDHPEEVSKLAKVKAQVSEVKGVMMENIEKVLDRGEKIELLVDKTENLRSQAQDFRQQGTNVRRKMWLQNMKIKLIVLGIIIALILIIILSVCHGFKCH

SEQ ID NO: 1277 - protein, 221 aa, Vitis vinifera
  misc_feature: Public GI ID no. 157336295
  misc_feature (1)..(221): Bit score of 138.3 for hmm based on sequences of FIGURE 13.
  misc_feature (127)..(215): Pfam Name: Synaptobrevin Pfam Description: Synaptobrevin
  misc_feature: Functional Homolog Of SEQ ID NO. 160
MSQESFIYSFVARGTMVLAEYTEFTGNFPAIATQCLQRLPSANNKFTYNCDHHTFNFLVEDGYAYCVVAKESVGKQVSIAFLERMKADFKKRYGGGKADTATAKSLNKDFGPIMKEHMQYIIDHAEEIEKLLKVKAQVSEVKSIMLENIDKTLERGENLTILADKTEDLRSQAQQFKKQGSQVRRKMWFQNMKIKLVVLGILLILALVIWVSICHGFNCSK

SEQ ID NO: 1278 - DNA, 945 bp, Panicum virgatum
  misc_feature: Ceres Clone ID no. 1768420
  misc_feature: Encodes the peptide sequence at SEQ ID NO. 1279
acacggcagacgagaggaggcgaggccggccaccccggggggaggagtggcgggcgcggggatggcgatccagtacgcgctggtggcgcgcggcacggtggtgctggcggagcacagcgccgcggccaccaacgcgggcgccgtcacgcgccaggtcctcgagcgcctccccggcggcggcgccgacagccacgtctcctacacgcaggaccgctacgtcttccacgccaagcgcaccgacggcatcaccgcgctctgcatggccgacgacgccgccgggagacggataccctttgcatttttggaagacattcatggaagatttgtcaaaacatatggccgcgctgcgctgactgctcttgcgtatgcaatgaatgatgaattctcaagggttcttagccagcaaatggactactattcaaatgaccctaacgcagatagaataaaccgcatgagaggtgaaatcaatcaggttcgtagtgttatgattgataacattgacaaagtccttgaaagaggtgaccgtttggagctgctggttgacaagaccgcaaatatgcaaggaaatactgttcgattcagaagacaagctcggcgcttcagaaacaccgtttggtggagaaatgtcaaactcacggctgcgttgatacttctccttctggtaatagtatatgttgcgcttgtcttcgtgtgccatggtttcaccttaccaacttgtatacgctagggtatggtgtgcctgtttgtgtgattatgtctccattccttgggagcagctatcgcagtactgttgcagttggttttgatgtagaggaaagctccagattgtggtgtaatagtgatggtgtcaattgtgaaaaactcaattaaagatgtaaacttcacataagactgcatctcgcagggtcttgctatggcgtagctgcgcgcgcctgggttgtgttc

SEQ ID NO: 1279 - protein, 221 aa, Panicum virgatum
  misc_feature: Ceres Clone ID no. 1768420
  misc_feature (1)..(221): Bit score of 645.3 for hmm based on sequences of FIGURE 13.
  misc_feature (124)..(212): Pfam Name: Synaptobrevin Pfam Description: Synaptobrevin
  misc_feature: Functional Homolog Of SEQ ID NO. 160
MAIQYALVARGTVVLAEHSAAATNAGAVTRQVLERLPGGGADSHVSYTQDRYVFHAKRTDGITALCMADDAAGRRIPFAFLEDIHGRFVKTYGRAALTALAYAMNDEFSRVLSQQMDYYSNDPNADRINRMRGEINQVRSVMIDNIDKVLERGDRLELLVDKTANMQGNTVRFRRQARRFRNTVWWRNVKLTAALILLLLVIVYVALVFVCHGFTLPTCIR

SEQ ID NO: 1280 - DNA, 680 bp, Panicum virgatum
  misc_feature: Ceres Clone ID no. 1829174
  misc_feature: Encodes the peptide sequence at SEQ ID NO. 1281
aaatccaaatctatctgatcagatctctccgacccccatccccatggcgatcgtgtacgcgctggtggcgcgcggcaccgtcgtgctggccgagttcgccgccgtctcgggcaacgccggcgccgtcgcccgccgcatcctcgagaagctgccgcccgacgccgactcccgcctctgcttcgcgcaggaccgctacatcttccacgtcctccgcgccgacgccggcatcaccttcctctgcatggccaacgacaccttcggaaggaggatcccctttctctacctggaggatatccagatgaggttcatgaagaactacggcagagtcgcgcactccgcgctcgcctatgccatgaacgatgagttctccagggtcctccaccaccaaatggagttcttctccagcaaccccagcgccgacacgctcaaccgtctccgtggagaagtcagcgagatacacaccgttatggtcgacaacatagagaaaattctagacagaggtgaccgcatctcactccttgtcgacaagacatccaccatgcaagacagcgctttccacttccgcaagcaatccaagaggctccgcagagcgctttggatgaagaatgccaagcttctagctgtgttgacggttgccatagtagtgctactctacttgctcatttctgctttctgtggag

SEQ ID NO: 1281 - protein, 212 aa, Panicum virgatum
  misc_feature: Ceres Clone ID no. 1829174
  misc_feature (1)..(212): Bit score of 557.8 for hmm based on sequences of FIGURE 13.
  misc_feature (124)..(212): Pfam Name: Synaptobrevin Pfam Description: Synaptobrevin
  misc_feature: Functional Homolog Of SEQ ID NO. 160
MAIVYALVARGTVVLAEFAAVSGNAGAVARRILEKLPPDADSRLCFAQDRYIFHVLRADAGITFLCMANDTFGRRIPFLYLEDIQMRFMKNYGRVAHSALAYAMNDEFSRVLHHQMEFFSSNPSADTLNRLRGEVSEIHTVMVDNIEKILDRGDRISLLVDKTSTMQDSAFHFRKQSKRLRRALWMKNAKLLAVLTVAIVVLLYLLISAFCG

SEQ ID NO: 1282 - DNA, 744 bp, Panicum virgatum
  misc_feature: Ceres Clone ID no. 1865925
  misc_feature: Encodes the peptide sequence at SEQ ID NO. 1283
tccttgcccccctcatccacccacttccggcgagctctacaccggcggcagcggaggagcgtgggggctgatcctagggggcgaaggagcagcggagcggagacgaagcgatggggcagcagcagctgatctacgcgttcgtggcgcggggcacggtggtgctggccgagtacaccgagttcaccggcaacttcaccaccatcgccgcccagtgcctgcagaagctccccgccagcaacaacaagttcacatacaactgcgacggccacaccttcaactacctcgtcgaggacggattcacgtactgtgtggttgctgttgagtcagttggccgacaaatccccataggtttcctggacagagttaaggaagacttcacgaaaaaatatggtggtggaaaagcagctactgcagcagcaaacagcttgaacagggagtttggatcaaaacttaaggagcacatgcagtactgtgtggaccacccagaggaggtcagcaagcttgccaaggtgaaagcccaagtctcagaagtcaaaggagttatgatggagaatattgagaaggttctggaccgtggggagaagattgagctgcttgttgacaagactgaaaatctgcgttctcaggcacaagatttcaggcagcagggcacccaggtgcggcgaaagatgtggctgcagaacatgaagatcaagctgatcgtcctgggcattatcattgcgctcatccttatcatcatcctgt

SEQ ID NO: 1283 - protein, 211 aa, Panicum virgatum
  misc_feature: Ceres Clone ID no. 1865925
  misc_feature (1)..(211): Bit score of 153.2 for hmm based on sequences of FIGURE 13.
  misc_feature (127)..(211): Pfam Name: Synaptobrevin Pfam Description: Synaptobrevin
  misc_feature: Functional Homolog Of SEQ ID NO. 160
MGQQQLIYAFVARGTVVLAEYTEFTGNFTTIAAQCLQKLPASNNKFTYNCDGHTFNYLVEDGFTYCVVAVESVGRQIPIGFLDRVKEDFTKKYGGGKAATAAANSLNREFGSKLKEHMQYCVDHPEEVSKLAKVKAQVSEVKGVMMENIEKVLDRGEKIELLVDKTENLRSQAQDFRQQGTQVRRKMWLQNMKIKLIVLGIIIALILIIIL

SEQ ID NO: 1284 - DNA, 1135 bp, Panicum virgatum
  misc_feature: Ceres Clone ID no. 1956654
  misc_feature: Encodes the peptide sequence at SEQ ID NO. 1285
agattccatcgaatccttccttctaactctccaccgcgggaaggaaggagggagacgaagcagaagcttctcgcagggccttcccgttcggcggcgtttgtggcggggcgactccgggcgccatgagcagcagcaagcaggcgctgatttacagcttcgtcgccaagggctccgtcgtgctggcggagcacaccgccttctccggcaacttcagcaccgtcgccgtccagtgcctccagaagctgccccccaacagcaccagatccacctactcctgcgatggccacaccttcaacttcctcgtcgaccgcggcttcgtgttcctagtggtcgcggatgaggcggccgggaggagcgttcccttcgtcttcctagagagggttagggaagacttcatgcagcggtatgggtccagcatcgacgaggaggggcagcacccgctcgctgatgatgcggacgaagatgactttctgttcgaagaccgcttcagcattgcctacaaccttgaccgtgaattcggcccgaggttaaaggatcatatgcagtattgtgttaaccmcccagaggaaattaacaagctctccaaggtgaaggcccacctgtcagaagtcaaagggatcatgatggataatattgagaagatattggaccgtggtgagaagattgagcttttggtggggaagactgagaccttgcaatcacaggctgacaccttccacaggcatggcagagagctgaggcgaaagatgtggcttcagaacctaaggttcaagctgatggttggtggaggcattgcagctctgattctcatcctttggctgatggtctgcaggggattcaaatgttagatcgctcgaaatcattgctcgccctctcactttttttttaaaaaaaagaagtgtttgtgttgttgaccgtttcacatgcacagaatggtcaccgaatcatgtttcagtcatgctgtgggtattggtatcgcttagcagatgttaattctgtgcggtccttgccgtgtttcatatgataatggtaggcagctatagtacctgtgatagataactttgtgggagaaggggatatgacactatgacctttattgtctgtacattctgaaatgcaaactcttattatttgg

SEQ ID NO: 1285 - protein, 241 aa, Panicum virgatum
  misc_feature: Ceres Clone ID no. 1956654
  misc_feature (1)..(241): Bit score of 145.4 for hmm based on sequences of FIGURE 13.
  misc_feature (149)..(237): Pfam Name: Synaptobrevin Pfam Description: Synaptobrevin
  misc_feature: Functional Homolog Of SEQ ID NO. 160
  misc_feature (146)..(146): Xaa is any aa, unknown, or other
MSSSKQALIYSFVAKGSVVLAEHTAFSGNFSTVAVQCLQKLPPNSTRSTYSCDGHTFNFLVDRGFVFLVVADEAAGRSVPFVFLERVREDFMQRYGSSIDEEGQHPLADDADEDDFLFEDRFSIAYNLDREFGPRLKDHMQYCVNXPEEINKLSKVKAHLSEVKGIMMDNIEKILDRGEKIELLVGKTETLQSQADTFHRHGRELRRKMWLQNLRFKLMVGGGIAALILILWLMVCRGFKC

SEQ ID NO: 1286 - protein, 220 aa, Elaeis guineensis
  misc_feature: Public GI ID no. 192910812
  misc_feature (1)..(220): Bit score of 182.1 for hmm based on sequences of FIGURE 13.
  misc_feature (127)..(215): Pfam Name: Synaptobrevin Pfam Description: Synaptobrevin
  misc_feature: Functional Homolog Of SEQ ID NO. 160
MGQQTLIYSFVARGTVILAEYTEFTGNFTSIASQCLQKLPSSNNKFTYNCDSHTFNYLVEDGFTYCVVAVESAGRQIPIAFLERVKEDFKKRYGGGKAATASANSLNREFGPKLKEHMQYCVDHPEEISKLSKVKAQVSEVKGVMMENIEKVLERGEKIELLVDKTENLRSQAQDFRQQGTKMRRKMWLQNMKIKLIVLGIIIALILIIILSVCHGFKCT

SEQ ID NO: 1287 - protein, 220 aa, Physcomitrella patens subsp. patens
  misc_feature: Public GI ID no. 168019158
  misc_feature (1)..(220): Bit score of 542.8 for hmm based on sequences of FIGURE 13.
  misc_feature (123)..(211): Pfam Name: Synaptobrevin Pfam Description: Synaptobrevin
  misc_feature: Functional Homolog Of SEQ ID NO. 160
MAILYALVARGTVVLAEFSAASGNASTIARRILEKLPPGGDSRVSYSQDRHIFHILKADGLTFLCMATDSFGRRIPFAYLEDIHMRFMKNYGKVASTALAYTMNDEFSRVLHQQMEYFSTNKQADSINRVKGEIVEVRAVMVENIDKVLERGDRIELLVDKTATIQDNTFRFKKQSRRLRQAMWIKNAKLLATLTCLIIVLLYIIISFFCGGIFLRSCRG

SEQ ID NO: 1288 - protein, 215 aa, Ostreococcus lucimarinus CCE9901
  misc_feature: Public GI ID no. 145347629
  misc_feature (1)..(215): Bit score of 162.8 for hmm based on sequences of FIGURE 13.
  misc_feature (123)..(211): Pfam Name: Synaptobrevin Pfam Description: Synaptobrevin
  misc_feature: Functional Homolog Of SEQ ID NO. 160
MPLIYAFVARRTTVLAEFTNYSGNFSTIAIQALEKLSDDNTRFTYTADGHTFNYVVENGFTYLVVADSELGRHVPFACLDRIKSEFTRDHASEAQDAIAHSLNKSFAPRLKEHLEFCSANPEAVSKVSAVQQQVSQVKEIMMDNIEKVLDRGEKIELLVDKSDALRFEAANFHKTGRALRRNLWCQNMKIKVAFGLIIFALLLTLIFTLCGKKCR

SEQ ID NO: 1289 - DNA, 940 bp, Gossypium hirsutum
  misc_feature: Ceres Clone ID no. 1918584
  misc_feature: Encodes the peptide sequence at SEQ ID NO. 1290
cgcactgttttaataaaaatcctcctcaacttccccaactccaactccattacttcagatctgaattcccaaatatatttgcacaatccagagcagagtaatggggatattgtacgggatggtagcaagggggcaggtggtgttggccgagttcagcgcaactcagactaatgccattgccagcgttgtagccaggctgatactggagaagatgaaagaagtgaagaataatagtatttcatcgttttcacatcatccttatatttttcatgtcaagggaaccgatggtctcaccgttctttgcatggccgatgatgcctccggaaggataatcccttccgctttccttgaagatatccataaaaaatttgtaaagacatttggtcgtgctgttcattcggcttcagcttatgctatgaatgatgaattctccagggttctatgtcaacaaatagatcatttctcaagaaacccaaatgttgatagattaaaccgtttaaaaggggagatgaaccaggtacagagtgtattgattgacaatattgagaaagccttggagagaggcgaccgcttggcgcttcttgttgaaaaggctataacaatgcagtagcctatgcaggggaataatagtacagttgcgctcaaaaggaaagctcgtagttacaaaaatgctatgtggtggagagattggcgacattgatgctgttgtttttgctgaccatcgtttatgtttcgctcgcatttgtttgtaatggcctctttttatcgtcctgcttcaatcatatgacaatggcttccgtggttcctcacatgttttatgagtagctgttagctgtaatccctaaatgcctgtaatgatacaattcgtttagaaatgtatgcataagctgcaattcaaagaatattacaagaagatataaaaagagtgtcctttacattt

SEQ ID NO: 1290 - protein, 169 aa, Gossypium hirsutum
  misc_feature: Ceres Clone ID no. 1918584
  misc_feature (1)..(169): Bit score of 270.9 for hmm based on sequences of FIGURE 13.
  misc_feature (126)..(169): Pfam Name: Synaptobrevin Pfam Description: Synaptobrevin
  misc_feature: Functional Homolog Of SEQ ID NO. 160
MGILYGMVARGQVVLAEFSATQTNAIASVVARLILEKMKEVKNNSISSFSHHPYIFHVKGTDGLTVLCMADDASGRIIPSAFLEDIHKKFVKTFGRAVHSASAYAMNDEFSRVLCQQIDHFSRNPNVDRLNRLKGEMNQVQSVLIDNIEKALERGDRLALLVEKAITMQ

SEQ ID NO: 1291 - DNA, 1067 bp, Gossypium hirsutum
  misc_feature: Ceres Clone ID no. 1850218
  misc_feature: Encodes the peptide sequence at SEQ ID NO. 1292
ccccttctctctctccatccttaaagaacacaatatttccctcatagagagcatgttgaggattggattcagaaacatcattaatggcttcatatgtagagcctcacttcctcagtgcttttataacagggaattatcgacacaaactggaaggctgaaaggcaaaatagcattgatcactggggcagcaagcggtatcgggaaggcagctgcagcgaaattcatcagtaatggtgccaaagtcgtcattgctgatatacaacaccaactagggcaagcaacggcgaatgagcttggacccaatgctacttttataccctgtgacgtaacggaagaatcagatgtatccgatgctgttgactttaccgtctccaaacacaaacgactggatgttatgtacaataatgctggggtaccttgctacacgcctccgagcattgtggaccttgaccttgccattttcgacagagttatgggcatcaatgtgcgaggagtcttggccggcatcaaacacgcttcgcgtgtgatgatccctagtagaactggctccattctgtgcacagctagcgtaactggaatgatgggtggactagctcaacatacttacagtgtgtccaagtctgctgtcataggaattgttaagtccatggcagctgagctatgccagtacggaatccgtgtcaactgcatatcaccttttgcagttccgactccatttacactagatgagatgagccagatttatccacaaattgatgccgagcagctcgtcaaaatgatacatagttttggtgtgctcggcaaagcaacattggaaccaggtgatgtagccgatgccgcagtctatcttgcatcagatgatgcaaagtatgttagtgggcataatttggtggtagatggaggttttacatcatttaagagattggaacttcctaagagctaaagtcttataaatgctgctcaaaggatatattttggaaattgaagtacgaggtatatttcaagtttcttctagtttttgacagtctggggaacaacaattagactaaacacaaatgaatttcagt

SEQ ID NO: 1292 - protein, 296 aa, Gossypium hirsutum
  misc_feature: Ceres Clone ID no. 1850218
  misc_feature (1)..(296): Bit score of 381.7 for hmm based on sequences of FIGURE 8.
  misc_feature (38)..(204): Pfam Name: adh_short Pfam Description: short chain dehydrogenase
  misc_feature: Functional Homolog Of SEQ ID NO. 1012
MLRIGFRNIINGFICRASLPQCFYNRELSTQTGRLKGKIALITGAASGIGKAAAAKFISNGAKVVIADIQHQLGQATANELGPNATFIPCDVTEESDVSDAVDFTVSKHKRLDVMYNNAGVPCYTPPSIVDLDLAIFDRVMGINVRGVLAGIKHASRVMIPSRTGSILCTASVTGMMGGLAQHTYSVSKSAVIGIVKSMAAELCQYGIRVNCISPFAVPTPFTLDEMSQIYPQIDAEQLVKMIHSFGVLGKATLEPGDVADAAVYLASDDAKYVSGHNLVVDGGFTSFKRLELPKS

SEQ ID NO: 1293 - protein, 352 aa, Vitis vinifera
  misc_feature: Public GI ID no. 157336541
  misc_feature (1)..(352): Bit score of 364.5 for hmm based on sequences of FIGURE 11.
  misc_feature (36)..(203): Pfam Name: HSF_DNA-bind Pfam Description: HSF-type DNA-binding
  misc_feature: Functional Homolog Of SEQ ID NO. 364
MNPPVRGSSSSYPDEPLIAASQRPQPMEGLHDIGPPPFLNKTYDLVDDPSTDSIVSWSIGNNSFVVWDPQIFAGNLLPRYFKHNNFSSFVRQLNTYGFRKVDPDRWEFANEEFLRGQKPLLKKIKRKKALQPYTSQQAVGPSVEVERFGLDGEVDHRRRDKEVLMMELVKLRRQQQDTRAYLQAMEQRIKGTELKLKQMMNFWAKVIKNPSIIQKLVQQSRTKELESALTKKRRLIDEVPTYVEAPGEGTSVKIEPHDYDDISAFEVSELDTLAMDMEGLSKTGKKPGNEQIEKEEMKLESGNKALDIGIWEEFLNEELEGDMGLLGTVGGDDEEDVNVLVDQLCDLVSSPV

SEQ ID NO: 1294 - protein, 358 aa, Vitis vinifera
  misc_feature: Public GI ID no. 157335907
  misc_feature (1)..(358): Bit score of 638.0 for hmm based on sequences of FIGURE 9.
  misc_feature (117)..(350): Pfam Name: Trehalose_PPase Pfam Description: Trehalose-phosphatase
  misc_feature: Functional Homolog Of SEQ ID NO. 1129
MTNQNVAVSDPKSAIGMAIDVIVSNSSFFSPAVRKPPTVPGGYITISLKKLETGGAGGAGRVGAWVDSMRASSPTHIKSTPLSDSEALSSWMLHHPSALRTFEQITNASEGKQIVMFLDYDGTLSPIVEDPDQAFMSKEMRAAVKDVARYFPTAIVSGRCRDKVYRFVKLSELYYAGSHGMDIKGPAKGRKYKKGDQSLLCQPASEFLPMIDEVYKALLEKTKSTPGAKVENNKFCLSVHFRCVDEQRWTALAEQVRLVLNQYPKLRLTQGRKVLEIRPTIKWDKGNALEFLLESLGYANSNDVFPIYIGDDRTDEDAFKVLRNRGQGFGILVSKFPKETSASYSLQEPTEARTLIWT

SEQ ID NO: 1295 - DNA, 1135 bp, Zea mays
  misc_feature: Ceres Clone ID no. 100861292
  misc_feature: Encodes the peptide sequence at SEQ ID NO. 1296
ccctcgtctccgcacagagagggctcctcgctgccgtgtgccgggcttcactttcccctctcgtctcctctcccatggctcagcgcgacaagaaggtggaggagccgacggagctgcgcgcgccggagctcacgctgtgcgccaacagctgcggcttcccgggcaacccggccaccaacaacctctgccaggcctgcttcctggccgccacggcttcctcctccgcctccgcctccgtctcgccgccgccgccctcctcctcctcctcgtcgccggcggtgctccagttcgacgagcagcagcagcagcaaaatccgaggccgcgtgcgccggcggcgtccgggcccacggaggaaccgcccaggccggcccgggcgtcagctccggctccggctccggcgtcgtcctcgtccgtccgccggtgccagacctgccgcaagcgggtggggctcacgggcttccgctgccgctgcggagacctcttctgcggcgcgcaccgctactcggaccgccacgactgctgcttcgactacagggccgccggccgcgacgccatcgccagggacaaccccgtcgtgcgcgccgccaagatcgttaggttctaggcgtctcggatccggccggaggagctagctagctagctaggggcgggcacacacacgcacmcgcggtgatgggcgccgagatccgtcgccggtcctcatcgccctctatagtccgtccccccttcctctcctcctctccctctttgattgtcctctcctttttttcttgctgtcatctatttttattgcgagggggaaaaatgatttgatggtcaccgatcgatccgtccttggagggtgttggttatgtgttgatcgccatgctgttttagaaaattattccgtttacgaggacgacgatcgacgagaagcgtcgaaaaagagaggggggagagaatgaagacgaaaagaatagtgcgatgataacgttgttgttgttgtttgtagcggtggtggtggtggctggtggaagcgatatggttcggttcggttcggtgtgctcttgtcctgctgggaatcacaaattcctgttgaattttttttatatatctttgtataaaacgaaattgaaaatgtttatatggtgtgcc

SEQ ID NO: 1296 - protein, 176 aa, Zea mays
  misc_feature: Ceres Clone ID no. 100861292
  misc_feature (1)..(176): Bit score of 345.8 for hmm based on sequences of FIGURE 15.
  misc_feature (117)..(157): Pfam Name: zf-AN1 Pfam Description: AN1-like Zinc finger
  misc_feature (19)..(43): Pfam Name: zf-A20 Pfam Description: A20-like Zinc finger
  misc_feature: Functional Homolog Of SEQ ID NO. 749
MAQRDKKVEEPTELRAPELTLCANSCGFPGNPATNNLCQACFLAATASSSASASVSPPPPSSSSSSPAVLQFDEQQQQQNPRPRAPAASGPTEEPPRPARASAPAPAPASSSSVRRCQTCRKRVGLTGFRCRCGDLFCGAHRYSDRHDCCFDYRAAGRDAIARDNPVVRAAKIVRF

SEQ ID NO: 1297 - DNA, 731 bp, Panicum virgatum
  misc_feature: Ceres Clone ID no. 1875452
  misc_feature: Encodes the peptide sequence at SEQ ID NO. 1298
aaacccatttccttcctgcctccacgacccagcccaggcccggcggtgcctctccctctcgtctccggatcggcaagagcccagctgctgccggattcacacgacacctcgtcgtctctctctctctctctctctctctctctctctctctcggcccatggcgcagcgcgacaagaaggtggaggagccgacggagctgcacgcgccggagctcacgctctgcgccaacagctgcggcttcccgggcaacccggcgaccaagaacctctgccagaactgcttcctggccgcctcggcctccgtgtcgccgccgtcgccctcctcctcctcgtcgccctcgccggcggtgttcgacaagccgcggccggcggccgcccctcccgccgtgtggccgccgttccccgcggccgccgaccggcccccggcgggccccgcggagtccccctccaaggcgccccggacgtcgtcgtcggtcaaccggtgccacagctgccagaagcgggtcgggctgacggggttccggtgccgctgcggcgagctcttctgcggcgcgcaccggtactcggaccgccacgactgcggctacgactacaagggcgtcgcccgggacgccatcgcccgggagaaccccgtcgtgcgcgccgccaagatcgtcaggttctgagagctggggagcaccggaggagaccacgcagctcagctccacgccgatcgtcgatccatctcccgcg

SEQ ID NO: 1298 - protein, 168 aa, Panicum virgatum
  misc_feature: Ceres Clone ID no. 1875452
  misc_feature (1)..(168): Bit score of 339.7 for hmm based on sequences of FIGURE 15.
  misc_feature (109)..(149): Pfam Name: zf-AN1 Pfam Description: AN1-like Zinc finger
  misc_feature (19)..(43): Pfam Name: zf-A20 Pfam Description: A20-like Zinc finger
  misc_feature: Functional Homolog Of SEQ ID NO. 749
MAQRDKKVEEPTELHAPELTLCANSCGFPGNPATKNLCQNCFLAASASVSPPSPSSSSSPSPAVFDKPRPAAAPPAVWPPFPAAADRPPAGPAESPSKAPRTSSSVNRCHSCQKRVGLTGFRCRCGELFCGAHRYSDRHDCGYDYKGVARDAIARENPVVRAAKIVRF

SEQ ID NO: 1299 - DNA, 829 bp, Zea mays
  misc_feature: Ceres Clone ID no. 296366
  misc_feature: Encodes the peptide sequence at SEQ ID NO. 1300
gctcaggccagccgtgcggtagcttctccccccctcgtctccgcacagagagggctcctcgctgccgtgtgccggccttcactttcccctctcgtctcctctcctctcccatggctcagcgcgacaagaaggtggaggagccgacggagctgcgcgcgccggagctcacgctgtgcgccaacagctgcggcttcccgggcaacccggccaccaacaacctctgccaggcctgcttcctggccgccacggcttcctcctccgcctccgtctcgccgccgccgccctcctcctcctcgtctccggcggtgctccagttcgacgaccagcagcaaaatccgaggccgtgtgcgccggcggcgtccgggcccacggaggaaccgcccaggccggcccgggcgtcagcgccggcgtcgtcctcgtccgtccgccggtgccagacctgccgcaagcgggtggggctcacgggcttccgctgccgctgcggggacctcttctgcggcgcgcaccgctactcggaccgccacgactgctgcttcgactacagggccgccggccgcgacgccatcgccagggacaaccccgtcgtgcgcgccgccaagatcgttaggttctaggcgtctcggatccggccggaggagctagctagctagctaggggcgggcacacacacacacacacgcggtgatgggcgccgagatccgtcgccggtcctcatcgccctctatagtccgtcccccttcctctcctcctctccctctttgattgtcctctccttttcttctactgtcatctatttttattgcgagggggaaaaaatgatttgatggtc

SEQ ID NO: 1300 - protein, 167 aa, Zea mays
  misc_feature: Ceres Clone ID no. 296366
  misc_feature (1)..(167): Bit score of 339.6 for hmm based on sequences of FIGURE 15.
  misc_feature (108)..(148): Pfam Name: zf-AN1 Pfam Description: AN1-like Zinc finger
  misc_feature (19)..(43): Pfam Name: zf-A20 Pfam Description: A20-like Zinc finger
  misc_feature: Functional Homolog Of SEQ ID NO. 749
MAQRDKKVEEPTELRAPELTLCANSCGFPGNPATNNLCQACFLAATASSSASVSPPPPSSSSSPAVLQFDDQQQNPRPCAPAASGPTEEPPRPARASAPASSSSVRRCQTCRKRVGLTGFRCRCGDLFCGAHRYSDRHDCCFDYRAAGRDAIARDNPVVRAAKIVRF

SEQ ID NO: 1301 - DNA, 1111 bp, Panicum virgatum
  misc_feature: Ceres Clone ID no. 2015820
  misc_feature: Encodes the peptide sequence at SEQ ID NO. 1302
cccccaacccatttccttcctgcccgcaacccagcccaggcccggcggtccctcgatcctctcggctccggatcggcaagagcccagccgcagccgcccgtagccgcctcgctgccggattcacacgacgccttgtcggcgtctctctctctctcgaggcccatggcgcagcgcgacaagaaggtggaggagccgacggagctgcacgcgccggagctcacgctctgcgccaacagctgcggcttcccgggcaacccggccaccaagaacctctgccagaactgcttcctggccgcctccgcctccgtctcgccgccgtcgccctcctcctcctcgccggcggtgttcgacaagccgcggacggcggcggcggcggccgcccctcccgcgctctggccgccgttctccccggccgccaaccggcccccggcgggccccgcggagtccccctccaaggcgccccggacgtcgtcgtcgatcaaccggtgccacagctgccggaagcgggtcgggctgacggggttccggtgccgctgcggcgagctcttctgcggcgcgcaccggtactcggaccgccacgactgcggctacgactacaagggcgtcgcccgggacgccatcgcccgggagaaccccgtcgtgcgcgccgccaagatcgtcaggttctgagagagctggggagcaccggaggaccacgcacagctcagctccacgccgatcgtcgatccatcatctcccgcgctccggaatcccctctcttttttctctttttctttcctcttttgttacaaaatttaaaggtgattggtcgagctgtcatcacgctgttctcgagaatcccacaaacaagaagaagatgatttgattgatgaaggaaaaagaagaaggagcagatcatgggaaccatgaaggcagggaagctgcgagaaaaaggggatcgagagcacagtgcgatgataatgttgttgttgtagcggtggttggggtggaggggaagagatagagtcggtttggtgtgttgtcctactacaaatcacaatcttctattaaatttttcttccatctctctgtataaactaaattataattgggatctccctattgcccagct

SEQ ID NO: 1302 - protein, 168 aa, Panicum virgatum
  misc_feature: Ceres Clone ID no. 2015820
  misc_feature (1)..(168): Bit score of 323.5 for hmm based on sequences of FIGURE 15.
  misc_feature (109)..(149): Pfam Name: zf-AN1 Pfam Description: AN1-like Zinc finger
  misc_feature (19)..(43): Pfam Name: zf-A20 Pfam Description: A20-like Zinc finger
  misc_feature: Functional Homolog Of SEQ ID NO. 749
MAQRDKKVEEPTELHAPELTLCANSCGFPGNPATKNLCQNCFLAASASVSPPSPSSSSPAVFDKPRTAAAAAAPPALWPPFSPAANRPPAGPAESPSKAPRTSSSINRCHSCRKRVGLTGFRCRCGELFCGAHRYSDRHDCGYDYKGVARDAIARENPVVRAAKIVRF

SEQ ID NO: 1303 - DNA, 1114 bp, Panicum virgatum
  misc_feature: Ceres Clone ID no. 1724165
  misc_feature: Encodes the peptide sequence at SEQ ID NO. 1304
caacccatttccttcctgcccgcaaggccgcaacccagcccaggcccggcggtccctcgatcctctcggctccggatcggcaagagcccagccgccgccgcccgtagccgcctcgctgccggattcacacgacaccttgtcggcgtctctttctctctctcgaggcccatggcgcagcgcgacaagaaggttgaggagccgacggagctgcacgcgccggagctcacgctctgcgccaacagctgcggcttcccgggcaacccggccaccaagaacctctgccagaactgcttcctggccgcctccgcctccgtctcgccgccgtcgccctcctcctcgccggcggtgttcgacaagccgcggacggcggcggcggcggccgcccctcccgcgctctggccgccgttctccccggccgccaaccggcccccagcgggccccgcggagtccccctccaaggcgccccggacgtcgtcgtcggtcaaccggtgccacagctgccggaagcgggtcgggctgacggggttccggtgccgctgcggcgagctcttctgcggcgcgcaccggtactcggaccgccacgactgcggctacgactacaagggcgtcgcccgggacgccatcgcccgggagaaccccgtcgtgcgcgccgccaagatcgtcaggttctgagagagctggggagcaccggaggaccacgcacagctcagctccacgccgatcgtcgatccatcatctcccgcgctccggaatcccctctcttttttctctttttctttcctcttttgttacaaaatttaaaggtgattggtcgagggtgctgtcatcacgctgttctcgagaatcccacaaacaagaagaagatgatttgattgatgaaggaaaaagaagaaggagcagatcatgggagccatgaaggcagggaagctgcgagaaaaaggggatcgagagcacagtgcgatgataatgttgttgttgtagcggtggttggggtggaggggaagagatagggtcggtttggtgtgttgtcctactacaaatcacaatcttctattaaatttttcttccatctctctgtataaactaaattataattggaatctccctattgccc

SEQ ID NO: 1304 - protein, 167 aa, Panicum virgatum
  misc_feature: Ceres Clone ID no. 1724165
  misc_feature (1)..(167): Bit score of 322.7 for hmm based on sequences of FIGURE 15.
  misc_feature (108)..(148): Pfam Name: zf-AN1 Pfam Description: AN1-like Zinc finger
  misc_feature (19)..(43): Pfam Name: zf-A20 Pfam Description: A20-like Zinc finger
  misc_feature: Functional Homolog Of SEQ ID NO. 749
MAQRDKKVEEPTELHAPELTLCANSCGFPGNPATKNLCQNCFLAASASVSPPSPSSSPAVFDKPRTAAAAAAPPALWPPFSPAANRPPAGPAESPSKAPRTSSSVNRCHSCRKRVGLTGFRCRCGELFCGAHRYSDRHDCGYDYKGVARDAIARENPVVRAAKIVRF

SEQ ID NO: 1305 - DNA, 951 bp, Brassica napus
  misc_feature: Ceres Clone ID no. 1030374
  misc_feature: Encodes the peptide sequence at SEQ ID NO. 1306
gaaactcagaaaagcagagaactttattctctcctctaacctctcaacttctgctggatctctccagcagacggaagatcttcttcggagagattcttaggggaccgaacgatctatcgatcaaggcttctcgggcaaacagaagtgcagaaatggaccacgacaagacaggatgccaaagcccacccgagggtcccaagctatgcatcaacaactgcggtttcttcggaagcgctgccacaatgaacatgtgttccaagtgccacaagactatcttgtttcaacaggaacagggggccaagcttgcatctgcagtgtctggatcacccagcaacatcctaaaggaaaccttcactgctgatttggttgatgctggaaccaaatccatcgagcctgtggctgtctctgtacaagctgttgcagaggtagtagcaccagaagaagctgcagcaaaaccaaaggaagggcccagccgatgtactacttgcaacaaacgggttggtttgactggattcaaatgtcgatgtggtgacctcttctgtggtacgcaccgctatgcagacgttcataactgctctttcgattaccatgttgctgcgcaagaagctatagccaaagcgaacccggttgtgaaggcagataagcttgacaagatctgaaactcagaaactatgtttccttcttcatgtccgtgtctggttcaagcgtgtgttgatctttagcttcttccgttctctctgccagtatctgtggtgtgaaaactttctatattatcttgtgtttgcaagcagagaagtgtgctcttaaatatatatatatgctttgatgtgtttctctttttttttttttaatattatttatgagcactatggtttggttatgtttactcctttgggtctgtatcatattgagattgtaactttagctatatgaagatttttcttaaaagct

SEQ ID NO: 1306 - protein, 168 aa, Brassica napus; identical to SEQ ID NO: 918
  misc_feature: Ceres Clone ID no. 1030374
  misc_feature (1)..(168): Bit score of 368.8 for hmm based on sequences of FIGURE 7.
  misc_feature (109)..(149): Pfam Name: zf-AN1 Pfam Description: AN1-like Zinc finger
  misc_feature (15)..(39): Pfam Name: zf-A20 Pfam Description: A20-like zinc finger
  misc_feature: Functional Homolog Of SEQ ID NO. 742

SEQ ID NO: 1307 - DNA, 784 bp, Musa acuminata
  misc_feature: Ceres Clone ID no. 1738028
  misc_feature: Encodes the peptide sequence at SEQ ID NO. 1308
acgatgagaccggatgccaagcacgtgaaggaccaatcctttgcatcaacaactgtggattcttcggaagtgccgcaaccatgaacttgtgctccaagtgccacaaggacatgattctcaagcaggaacaggccaagatggcggcatcctcgatcgacagcctcgtgaatggcaatggcaatggcagtggcagtggaaaagagcccgtcgtttcgggtaatgctgttgttgctgttggctccatggagccgaaagtgatttcagcacagtcatccgatgctttagcctcaaacgaggccggagaggcaaaggcgaaggagggtccaaacaggtgtggcacctgcaggaaacgcgttggtctgactggtttcagttgtcggtgtgggaaccttttctgtgctgtgcaccgctactcggataagcacgactgccaattcgactaccgaaaggcggcccaggatgcaattgccaaagcaaaccctgtcattaaggccgaaaagcttgataagatctagagatatgggttaaaggttaatgaactctgttccgatgatctccacgttatcatcatgccttttctttcggttggctggatgttggtgtcttttgatcctatatatatggctggaggaatgatgcatggggcatccttgcagcctctcaagaacctctatcttgttgattggaaaaggtttgcatgttggatctggtgtgtaatctttaatttgtgctggtttgcatggtggatgagtacaacgttatgctttagttaggtttgtgactt

SEQ ID NO: 1308 - protein, 144 aa, Musa acuminata
  misc_feature: Ceres Clone ID no. 1738028
  misc_feature (1)..(144): Bit score of 219.6 for hmm based on sequences of FIGURE 7.
  misc_feature (85)..(125): Pfam Name: zf-AN1 Pfam Description: AN1-like Zinc finger
  misc_feature (15)..(39): Pfam Name: zf-A20 Pfam Description: A20-like zinc finger
  misc_feature: Functional Homolog Of SEQ ID NO. 742
MNLCSKCHKDMILKQEQAKMAASSIDSLVNGNGNGSGSGKEPVVSGNAVVAVGSMEPKVISAQSSDALASNEAGEAKAKEGPNRCGTCRKRVGLTGFSCRCGNLFCAVHRYSDKHDCQFDYRKAAQDAIAKANPVIKAEKLDKI

SEQ ID NO: 1309 - protein, 169 aa, Oryza sativa subsp. japonica
  misc_feature: Public GI ID no. 115455855
  misc_feature (1)..(169): Bit score of 216.6 for hmm based on sequences of FIGURE 7.
  misc_feature (109)..(149): Pfam Name: zf-AN1 Pfam Description: AN1-like Zinc finger
  misc_feature (21)..(45): Pfam Name: zf-A20 Pfam Description: A20-like zinc finger
  misc_feature: Functional Homolog Of SEQ ID NO. 742
MASMKRKCPDDETACGSGAGAAMCVTGCGFFGSEATNNMCSRCYREHSADNDAVEEAAAANSDLELVGVAETTTKKARMSAVVPVAVASSSSAAAEQPAAKAATAPNRCAACRKKVGLTGFKCRCGGNFCGGHRHADAHGCGFDYKSAGKEQIAKQNPLVVADKLATRI

SEQ ID NO: 1310 - protein, 165 aa, Lotus japonicus; identical to SEQ ID NO: 817
  misc_feature: Public GI ID no. 193237563
  misc_feature (1)..(165): Bit score of 338.5 for hmm based on sequences of FIGURE 7.
  misc_feature (106)..(146): Pfam Name: zf-AN1 Pfam Description: AN1-like Zinc finger
  misc_feature (13)..(37): Pfam Name: zf-A20 Pfam Description: A20-like zinc finger
  misc_feature: Functional Homolog Of SEQ ID NO. 742

SEQ ID NO: 1311 - protein, 148 aa, Arabidopsis thaliana
  misc_feature: Ceres seedline no. ME04246
  misc_feature (1)..(165): Bit score of 388.2 for hmm based on sequences of FIGURE 16.
  misc_feature (45)..(102): Pfam Name: KH_2 Pfam Description: KH domain
MATQISKKRKFVADGVFYAELNEVLTRELAEDGYSGVEVRVTPMRTEIIIRATRTQNVLGEKGRRIRELTSLVQKRFKFPQDSVELYAEKVANRGLCAIAQAESLRYKLLGGLAVRRACYGVLRFVMESGAKGCEVIVSGKLRAARAK

SEQ ID NO: 1312 - DNA, 501 bp, Brassica napus
  misc_feature: Ceres Clone ID no. 971761
  misc_feature: Encodes the peptide sequence at SEQ ID NO. 1313
atcacagctcctacttggttccagcgttcgacagatttacatttcaacaccatggcgactcagatcagcaagaagagaaagtttgtagcggacggtgtgttctacgctgaactgaatgaggttttaaccagagagctagcggaggatgggtactcaggtgtagaggttagggttactccaatgaggactgagattatcatcagagccacccgcactcaaaatgttctaggtgagaaggggaggaggatcagggagctgacatcacttgtgcagaagagatttaggtttcctcaagacagtgttgagctttacgctgagaaggtcgccaacagaggtctttgtgccattgctcaggctgagtctctccgttacaagcttctcggtggtcttgctgttcgcagggcttgctatggtgtattgagattcgtcatggagagtggagctaagggatgtgaggtgattgtaagtgggaagctccgtgctgcgcgtgccaagtccatg

SEQ ID NO: 1313 - protein, 150 aa, Brassica napus
  misc_feature: Ceres Clone ID no. 971761
  misc_feature (1)..(150): Bit score of 396.7 for hmm based on sequences of FIGURE 16.
  misc_feature (45)..(102): Pfam Name: KH_2 Pfam Description: KH domain
  misc_feature: Functional Homolog Of SEQ ID NO. 1311
MATQISKKRKFVADGVFYAELNEVLTRELAEDGYSGVEVRVTPMRTEIIIRATRTQNVLGEKGRRIRELTSLVQKRFRFPQDSVELYAEKVANRGLCAIAQAESLRYKLLGGLAVRRACYGVLRFVMESGAKGCEVIVSGKLRAARAKSM

SEQ ID NO: 1314 - DNA, 944 bp, Brassica napus
  misc_feature: Ceres Clone ID no. 1076093
  misc_feature: Encodes the peptide sequence at SEQ ID NO. 1315
acagcgcttcacccatcttctcgagattacttcagcaatttagggtttcagtgatccgcagctgcacacatcaaacatggcgactcagattagcaagaagagaaagtttgtagctgacggtgtgttctacgctgagctgaacgaggttctaaccagagagctagcggaagatggttactctggtgtggaggttagggttactccgatgaggactgagattatcatcagagccacacgtactcaaaatgttctcggtgagaagggaaggaggatcagagagttgacatctcttgtgcagaagagattcaggtttcctcaagacagtgttgagctttacgctgagaaggttgccaacagaggtctctgcgccattgctcaggctgagtctcttcgttacaagctcctcggtgggcttgctgttcgcagggcttgctatggtgtcttgagattcgtcatggagagtggtgctaagggttgtgaggttattgtgagtggaaagcttcgtgcagcacgtgccaagtccatgaaattcaaggacggttacatggtttcctctggtcaaccaaccaaggattacatcgactctgcagtgagacatgttctgcttagacagggtgtgctcggaatcaaggtgaaggtcatgcttgactgggaccctaagggaataaatggacccaagacaccattgcctgatgttgtcatcatccatactcccaaggaggaagacgtcaactctgcacctgctcaggttgctgctccggctgctcttgcaccagaagctcccctcactgccgtagactaccctgagatgatcccagtcgcctagaagaaaccctttggttacccctaccaggggatacttctctttttgttataactttctgtatctctggatactcactagttgtttttcctatgtcctcgaagtagacaagttttttctc

SEQ ID NO: 1315 - protein, 249 aa, Brassica napus
  misc_feature: Ceres Clone ID no. 1076093
  misc_feature (1)..(249): Bit score of 478.3 for hmm based on sequences of FIGURE 16.
  misc_feature (45)..(102): Pfam Name: KH_2 Pfam Description: KH domain
  misc_feature: Functional Homolog Of SEQ ID NO. 1311
MATQISKKRKFVADGVFYAELNEVLTRELAEDGYSGVEVRVTPMRTEIIIRATRTQNVLGEKGRRIRELTSLVQKRFRFPQDSVELYAEKVANRGLCAIAQAESLRYKLLGGLAVRRACYGVLRFVMESGAKGCEVIVSGKLRAARAKSMKFKDGYMVSSGQPTKDYIDSAVRHVLLRQGVLGIKVKVMLDWDPKGINGPKTPLPDVVIIHTPKEEDVNSAPAQVAAPAALAPEAPLTAVDYPEMIPVA

SEQ ID NO: 1316 - DNA, 631 bp, Papaver somniferum
  misc_feature: Ceres Clone ID no. 1627875
  misc_feature: Encodes the peptide sequence at SEQ ID NO. 1317
aatcatctctcctctctttctcaacagcagcagcagcagtttttagggttttcaaagacgagcagctaagtcgctctcgtcttctttccactcacagatcttcaatcatggcgactcaaatgagtaagaaacgaaagttcgttgctgatggagtgttcttcgctgagttgaacgaagtattgacaagagaactagctgaagatggttactctggtgttgaagttagggttacacctatgaggactgaaatcatcatcagagctaccagaactcaaaatgttcttggtgagaagggaaggaggattagagaattgacctctgttgtacagaagaggtttaagttccctgagaacagtgttgagctttacgctgagaaggttaacaacagaggtttatgtgctattgcccaagctgagtctctcagatacaagcttcttggtgggcttgctgttcgtagggcctgctatggtgttttgagattcgtcatggaaagtggtgccaagggttgcgaggttattgtgagtggaaagcttagggcagctcgtgcgaagtcaatgaagttcaaggatggatacatgatttcttctggtcagcctgttaacgagtacattgactcagccgttagacacgt

SEQ ID NO: 1317 - protein, 174 aa, Papaver somniferum
  misc_feature: Ceres Clone ID no. 1627875
  misc_feature (1)..(174): Bit score of 486.7 for hmm based on sequences of FIGURE 16.
  misc_feature (45)..(102): Pfam Name: KH_2 Pfam Description: KH domain
  misc_feature: Functional Homolog Of SEQ ID NO. 1311
MATQMSKKRKFVADGVFFAELNEVLTRELAEDGYSGVEVRVTPMRTEIIIRATRTQNVLGEKGRRIRELTSVVQKRFKFPENSVELYAEKVNNRGLCAIAQAESLRYKLLGGLAVRRACYGVLRFVMESGAKGCEVIVSGKLRAARAKSMKFKDGYMISSGQPVNEYIDSAVRH

SEQ ID NO: 1318 - DNA, 711 bp, Populus balsamifera subsp. trichocarpa
  misc_feature: Ceres Annot ID no. 1508362
  misc_feature: Encodes the peptide sequence at SEQ ID NO. 1319
atggctacccaaatcagtaagaagcgcaaatttgttgcggatggagttttctacgcagagctgaatgaggtattgaccagagaattggctgaggatggatactctggtgttgaagttagggttactccgatgcgcactgagatcatcatcagggctactcgtactcaaaatgttcttggtgagaagggaaggaggatcagggagctgacttctgttgttcagaaacgttttaagtttcctgagaatggtgtggagctctatgctgagaaagttaacaacaggggtctctgtgccattgctcaggctgagtctcttcgttacaagcttcttggaggccttgctgttcgcagggcttgctatggtgtcctgagatttgtaatggagagtggggcaaaaggatgtgaggttattgtgagtggaaagcttagggcacagcgtgccaaatccatgaaatttaaggatgggtacatgatatcctctggccaacctgttaaagaatatattgatgcagctgttaggcatgttcttcttagacagggagtgcttggtatcaaggtcaagatcatgcttgactgggatcctaagggcaaggtggggccaatgactccactacctgatctggtcaccatccatcctcccaaggaagaagaagagtatgttgctccaccagtgatgacaaccaatatcgagattccagtagcattagcataa

SEQ ID NO: 1319 - protein, 236 aa, Populus balsamifera subsp. trichocarpa
  misc_feature: Ceres Annot ID no. 1508362
  misc_feature (1)..(236): Bit score of 488.3 for hmm based on sequences of FIGURE 16.
  misc_feature (45)..(102): Pfam Name: KH_2 Pfam Description: KH domain
  misc_feature: Functional Homolog Of SEQ ID NO. 1311
MATQISKKRKFVADGVFYAELNEVLTRELAEDGYSGVEVRVTPMRTEIIIRATRTQNVLGEKGRRIRELTSVVQKRFKFPENGVELYAEKVNNRGLCAIAQAESLRYKLLGGLAVRRACYGVLRFVMESGAKGCEVIVSGKLRAQRAKSMKFKDGYMISSGQPVKEYIDAAVRHVLLRQGVLGIKVKIMLDWDPKGKVGPMTPLPDLVTIHPPKEEEEYVAPPVMTTNIEIPVALA

SEQ ID NO: 1320 - DNA, 702 bp, Populus balsamifera subsp. trichocarpa
  misc_feature: Ceres Annot ID no. 1526950
  misc_feature: Encodes the peptide sequence at SEQ ID NO. 1321
atggccactcaaatcagtaagaaacgcaagtttgttgcggatggagttttctacgcagaactgaacgaggtattgactagagaattggctgaggatggatactctggtgttgaagttagggttactcccatgcgcaccgagatcatcatcagggctactcgtacccaaaatgttcttggtgagaagggaaggaggatcagggagctcacttccgttgtccagaaacgtttcaagtttcccgagaatggtgtcgagctctatgctgagaaagttaacaacaggggtctctgtgccattgcgcaggccgagtctcttcgttacaagctccttggaggccttgctgttcgcagggcttgttatggagtgttgaggtttgtaatggagagtggggcaaaaggatgtgaggttattgtgagtggaaagcttcgggcacagcgtgccaaatccatgaaattcaaggatgggtacatgatatcctctggccaacctgttaaagagtatattgattcagctgttaggcatgttcttcttagacagggtgtgcttggtatcaaggtcaagatcatgcttgactgggatccaaagggcaaggttgggccaatgacaccattacctgatctggtcacaatccatcctcccaaggaagaagaagagtatgttccaccattgttgaccaccaatattgagatcccagtagcataa

SEQ ID NO: 1321 - protein, 233 aa, Populus balsamifera subsp. trichocarpa
  misc_feature: Ceres Annot ID no. 1526950
  misc_feature (1)..(233): Bit score of 488.3 for hmm based on sequences of FIGURE 16.
  misc_feature (45)..(102): Pfam Name: KH_2 Pfam Description: KH domain
  misc_feature: Functional Homolog Of SEQ ID NO. 1311
MATQISKKRKFVADGVFYAELNEVLTRELAEDGYSGVEVRVTPMRTEIIIRATRTQNVLGEKGRRIRELTSVVQKRFKFPENGVELYAEKVNNRGLCAIAQAESLRYKLLGGLAVRRACYGVLRFVMESGAKGCEVIVSGKLRAQRAKSMKFKDGYMISSGQPVKEYIDSAVRHVLLRQGVLGIKVKIMLDWDPKGKVGPMTPLPDLVTIHPPKEEEEYVPPLLTTNIEIPVA

SEQ ID NO: 1322 - DNA, 1163 bp, Gossypium hirsutum
  misc_feature: Ceres Clone ID no. 1832333
  misc_feature: Encodes the peptide sequence at SEQ ID NO. 1323
attcatcaaatgtattttttaaatttccaaaaaagataatcttctaaaaatgaaaataaaacaaaaaatagaaaaccatcttttcttgtatttggattttggtttgaaaagtaattttgggtatctaacctaaccctagcccgccacctatccatatattttcgccccataaaaggaacactagttatactgttagctaattactagcaaagcggcgaagcgatttgcaatctcaactcaccgtttctcacgattggattctccttaaaatcatggctgctcagattagcaagaagcgcaagtttgttgcggatggagtgttttacgcggagctaaatgaggttttgacaagggagcttgctgaggatggatactccggagttgaagttagagttactcctatgcgtactgagatcatcatcagagctactcgtactcaaaatgttcttggtgagaagggtagaaggattagagagttgacttctgttgttcagaaacgattcaagtttccagagaacagtgtggaactctatgctgagaaagttaacaacaggggtctttgcgccattgcacaggccgaatccctgcgatacaagctccttggaggccttgctgttcggagggcttgctatggtgttctcagatttgtcatggagagtggagccaagggatgcgaggtcatagtgagtggaaaactccgagctcagcgtgcaaagtcgatgaagttcaaggatgggtacatgatatcctctggtcatcccgtcaaggaatatattgattctgctgttagacatgtccttcttaggcagggtgtgctgggtatcaaagttaaaatcatgctggattgggatccaaagggcaagcagggtccaatgaccccattgcctgatctcgtcaccatccaccctcccaaggaagaggaagagtatacagaaaagaaggactttgaaccgcttgctcccccaaccaatatcgaggttcctgttgtggtttagagcccaccccaaatgagccttgaatgtagtgtttcactcaagttttcaactatttagttaaaggagatcactagatttctgccagtacggattactattttgcgaatgaggtggattttggtcgtgtttagtgtacttggtatattttaaaggaatattattaagctc

SEQ ID NO: 1323 - protein, 240 aa, Gossypium hirsutum
  misc_feature: Ceres Clone ID no. 1832333
  misc_feature (1)..(240): Bit score of 486.6 for hmm based on sequences of FIGURE 16.
  misc_feature (45)..(102): Pfam Name: KH_2 Pfam Description: KH domain
  misc_feature: Functional Homolog Of SEQ ID NO. 1311
MAAQISKKRKFVADGVFYAELNEVLTRELAEDGYSGVEVRVTPMRTEIIIRATRTQNVLGEKGRRIRELTSVVQKRFKFPENSVELYAEKVNNRGLCAIAQAESLRYKLLGGLAVRRACYGVLRFVMESGAKGCEVIVSGKLRAQRAKSMKFKDGYMISSGHPVKEYIDSAVRHVLLRQGVLGIKVKIMLDWDPKGKQGPMTPLPDLVTIHPPKEEEEYTEKKDFEPLAPPTNIEVPVVV

SEQ ID NO: 1324 - protein, 230 aa, Chlamydomonas incerta
  misc_feature: Public GI ID no. 74272607
  misc_feature (1)..(230): Bit score of 468.1 for hmm based on sequences of FIGURE 16.
  misc_feature (45)..(102): Pfam Name: KH_2 Pfam Description: KH domain
  misc_feature: Functional Homolog Of SEQ ID NO. 1311
MAVQISKKRKFVADGVFYAELNELLTRELAEDGYSGVEVRVTPMRTEIIIRATRTQNVLGEKGRRIRELTSVVQKRFNFPPDSVELYAEKVSDRGLCAIAQAESLRYKLLGGLAVRRACYGVLRFVMESGAKGCEVIVSGKLRAARAKSMKFKDGYMVSSGHPARVYIDGAVRHVLLRQGVLGIKVKIMKEWDPTGKRGPRTPLPDVVKVLEPKEEEVYQEKPYIGKEEL

SEQ ID NO: 1325 - protein, 235 aa, Elaeis guineensis
  misc_feature: Public GI ID no. 192910782
  misc_feature (1)..(235): Bit score of 483.4 for hmm based on sequences of FIGURE 16.
  misc_feature (45)..(102): Pfam Name: KH_2 Pfam Description: KH domain
  misc_feature: Functional Homolog Of SEQ ID NO. 1311
MATQMSKKRKFVADGVFYAELNEVLTRELAEDGYSGVEVRVTPMRTEIIIRATRTQNVLGEKGRRIRELTSVVQKRFSFPENSVELYAEKVNNRGLCAIAQAESLRYKLLGGLAVRRACYGVLRFVMESGAKGCEVIVSGKLRAQRAKSMKFKDGYMISCGQPVKEYIDSAVRHVLLRQGVLGIKVKIMLDWDPKGKQGPATPLPDLASIHTPKDEEEYMRPPLTMAPELEVPVA

SEQ ID NO: 1326 - protein, 234 aa, Vitis vinifera
  misc_feature: Public GI ID no. 157342563
  misc_feature (1)..(234): Bit score of 486.3 for hmm based on sequences of FIGURE 16.
  misc_feature (45)..(102): Pfam Name: KH_2 Pfam Description: KH domain
  misc_feature: Functional Homolog Of SEQ ID NO. 1311
MATQMSKKRKFVADGVFFAELNEVLTRELAEDGYSGVEVRVTPMRTEIIIRATRTQNVLGEKGRRIRELTSVVQKRFKFPENSVELYAEKVNNRGLCAVAQAESLRYKLLGGLAVRRACYGVLRFIMESGAKGCEVIVSGKLRAQRAKSMKFKDGYMISSGQPVKEYIDSAVRHVLLRQGVLGIKVKIMLDWDPKGKQGPKTPLPDLVTIHTPKEEEEYIRPEKLATDIEVPTA

SEQ ID NO: 1327 - protein, 230 aa, Chlamydomonas reinhardtii
  misc_feature: Public GI ID no. 159483497
  misc_feature (1)..(230): Bit score of 464.8 for hmm based on sequences of FIGURE 16.
  misc_feature (45)..(102): Pfam Name: KH_2 Pfam Description: KH domain
  misc_feature: Functional Homolog Of SEQ ID NO. 1311
MAVQISKKRKFVQDGVFYAELNELLTRELAEDGYSGVEVRVTPMRTEIIIRATRTQNVLGEKGRRIRELTSVVQKRFNFPPDSVELYAEKVSDRGLCAIAQAESLRYKLLGGLAVRRACYGVLRFVMESGAKGCEVIVSGKLRAARAKSMKFKDGYMVSSGNPAKVYIDGAVRHVLLRQGVLGIKVKIMKEWDPTGKRGPRTPLPDVVKVLEPKEEEVYQEKPYIGKEEL

SEQ ID NO: 1328 - DNA, 1410 bp, Gossypium hirsutum
  misc_feature: Ceres Clone ID no. 1839999
  misc_feature: Encodes the peptide sequence at SEQ ID NO. 1329
tgctcacgcaatgtgatttctgcccagtgctctgaatgtcaaagtgaagaaattcaaccaagcgcgggtaaacggcgggagtaactatgactctcttaaggtagccaaatgcctcgtcatctaattagtgacgcgcatgaatggattaacgagattcccactgtccctgtctactatccagcgaaaccacagccaagggaacgggcttggcagaatcagcggggaaagaagaccctgttgagcttgactctagtccgactttgtgaaatgacttgagaggtgtaggataagtgggagctctcgggcgaaattgaaataccactacttttaacgttattttacttattccgtgaatcggaggcggggcacggcccctctttttggacccaaggccggcttcggccggccgatccgggcggaagacattgtcaggtggggagtttggctggggcggcacatctgttaaagtcttcttcagatcttatattcctgcaaattcccttcttttcccctccacccaagcctaaaaaatcatggcgacagctcaaatcagcaaaaagcgaaagttcgtcgctgatggagttttcttcgcggaactcaacgaggtattgaccagggaactggctgaggatggatactctggagtcgaagtcagagttactcctatgcgtacggagatcatcatcagagccacccgcacccaaaacgttctcggtgagaaaggtaggaggattagggagcttacctcagtggttcagaagcgattcaagttcccagaaaacagcgtcgagctttacgctgagaaggtcaacaacagaggtctttgcgctattgctcaggccgagtctcttcgctacaagctactcggaggtcttgccgttcgcagggcctgctatggtgtattgagattcatcatggagagtggtgccaagggatgcgaggttattgttagtggaaagctaagggcacagcgtgccaaatctatgaaattcaaggatggatatatgatctcttctggtcatcctgtcaatgagtatattgactctgctgtcagacatgttcttttgagacagggggtgcttggtatcaaggtcaagatcatgcttgactgggatcctaagggtaagcaaggccctactactcccctacctgatctagtcacaatccaccctcccaaggaggatgaagaaatcaggagagtagagcctgagccaactaatattgaggttccagttatggcttaaatgctgttttggttgacatctttttgattttaggaagtatgcgagtttcttagttttatgtagctaaaagtttggcctcaaagaccgctgctggttgcggtttcttctttttgtacttttaatgtttctcctactatagttattacgtaatcggtaattttctttc

SEQ ID NO: 1329 - protein, 236 aa, Gossypium hirsutum
  misc_feature: Ceres Clone ID no. 1839999
  misc_feature (1)..(236): Bit score of 486.0 for hmm based on sequences of FIGURE 16.
  misc_feature (46)..(103): Pfam Name: KH_2 Pfam Description: KH domain
  misc_feature: Functional Homolog Of SEQ ID NO. 1311
MATAQISKKRKFVADGVFFAELNEVLTRELAEDGYSGVEVRVTPMRTEIIIRATRTQNVLGEKGRRIRELTSVVQKRFKFPENSVELYAEKVNNRGLCAIAQAESLRYKLLGGLAVRRACYGVLRFIMESGAKGCEVIVSGKLRAQRAKSMKFKDGYMISSGHPVNEYIDSAVRHVLLRQGVLGIKVKIMLDWDPKGKQGPTTPLPDLVTIHPPKEDEEIRRVEPEPTNIEVPVMA

SEQ ID NO: 1330 - DNA, 611 bp, Gossypium hirsutum
  misc_feature: Ceres Clone ID no. 1946574
  misc_feature: Encodes the peptide sequence at SEQ ID NO. 1331
ctgagccgtcttcttcagatctcatattcctgcaaattcccttcttttcccctccacccaagcctaaaaaatcatggcgacagctcaaatcagcaaaaagcgaaagttcgtcgctgatggagttttcttcgcggaactcaacgaggtattgaccagggaactggctgaggatggatactctggagtcgaagtcagagttactcctatgcgtaccgagatcatcatcagagccacccgcacccaaaacgttctcggtgaaaaaggtaggaggattagggagcttacctcagtggttcagaagcgattcaagttcccagaaaacagcgtcgagctttacgctgagaaggtcaacaacagaggcctttgcgctattgcccaggccgagtctcttcgctacaagctactcggaggtcttgccgttcgcagggcctgctatggtgtactgagattcatcatggagagtggtgccaagggatgcgaggttattgttagtggaaagctaagagcacagcgtgccaaatctatgaaattcaaggatggatatatgatctcttctggtcatcctgtcaatgagtatattgactctgctgtcagacatgttcttttgagac

SEQ ID NO: 1331 - protein, 179 aa, Gossypium hirsutum
  misc_feature: Ceres Clone ID no. 1946574
  misc_feature (1)..(179): Bit score of 486.0 for hmm based on sequences of FIGURE 16.
  misc_feature (46)..(103): Pfam Name: KH_2 Pfam Description: KH domain
  misc_feature: Functional Homolog Of SEQ ID NO. 1311
MATAQISKKRKFVADGVFFAELNEVLTRELAEDGYSGVEVRVTPMRTEIIIRATRTQNVLGEKGRRIRELTSVVQKRFKFPENSVELYAEKVNNRGLCAIAQAESLRYKLLGGLAVRRACYGVLRFIMESGAKGCEVIVSGKLRAQRAKSMKFKDGYMISSGHPVNEYIDSAVRHVLLR

SEQ ID NO: 1332 - DNA, 939 bp, Glycine max
  misc_feature: Ceres Clone ID no. 467335
  misc_feature: Encodes the peptide sequence at SEQ ID NO. 1333
tattcctcaagaactagggtttgcagtcactgctctgtttcaccgagtttgggcgtttagatcagaaccaaatcgtgttctcttccattggcaaacatggcaactcaaatgagcaagaagagaaagtttgttgcggacggagtgttctttgccgaactgaacgaggttctgacacgtgaattggcggaggacggttactccggcgtcgaagttagggttacgccgatgcgcaccgagatcatcatcagagccaccagaacccaagccgttctaggtgagaagggaaggagaattagggaacttacctcagtggtgcagaagaggttcaaattccccgaaaacagcgtcgagctttatgctgagaaggtcaacaacagaggcctgtgtgccattgctcaggccgagtcgcttcgctacaagcttctcggtggcctcgccgttcgcagggcttgctatggtgttttaagatttgtgatggaaagtggtgccaagggttgtgaggtgattgttagtggaaagttgagggctcagagagccaaatccatgaaattcaaggatgggtacatgatcttttctggacaaccagtcaaggattacattgactctgcagtgagacatgtcctcctaagacagggtgttcttggtatcaaggttaagatcatgcttgattgggatcctaaagggaaacagggtcctaaaactccccttcctgatcttgtcacaatccacactcctaaggaagaggaagaatatgcccgtcctgctgctgttttggcaaccaatattgaggtccctgttgcttcttaagtagaaatcatagcacctgagtacctagtatgcagtgttcattggcttagacgtggtcagatttttgtagtgtcttatcttttcaagaatttttatactccagtacaaggatccaagcataaattatgttac

SEQ ID NO: 1333 - protein, 236 aa, Glycine max
  misc_feature: Ceres Clone ID no. 467335
  misc_feature (1)..(236): Bit score of 481.8 for hmm based on sequences of FIGURE 16.
  misc_feature (45)..(102): Pfam Name: KH_2 Pfam Description: KH domain
  misc_feature: Functional Homolog Of SEQ ID NO. 1311
MATQMSKKRKFVADGVFFAELNEVLTRELAEDGYSGVEVRVTPMRTEIIIRATRTQAVLGEKGRRIRELTSVVQKRFKFPENSVELYAEKVNNRGLCAIAQAESLRYKLLGGLAVRRACYGVLRFVMESGAKGCEVIVSGKLRAQRAKSMKFKDGYMIFSGQPVKDYIDSAVRHVLLRQGVLGIKVKIMLDWDPKGKQGPKTPLPDLVTIHTPKEEEEYARPAAVLATNIEVPVAS

SEQ ID NO: 1334 - protein, 231 aa, Physcomitrella patens subsp. patens
  misc_feature: Public GI ID no. 168010087
  misc_feature (1)..(231): Bit score of 478.2 for hmm based on sequences of FIGURE 16.
  misc_feature (45)..(102): Pfam Name: KH_2 Pfam Description: KH domain
  misc_feature: Functional Homolog Of SEQ ID NO. 1311
MATQMSKKRKFVADGVFFAELNELLTRELAEDGYSGVEVRVTPMRTEIIIRATRTQNVLGEKGRRIRELTSVVQKRFQFPEGTVELYAEKVNNRGLCAIAQAESLRYKLLGGLAVRRACYGVLRFIMESGAKGCEVIVSGKLRAARAKSMKFKDGYMISSGSPVNDYIDSAVRHVMLRQGVLGIKVKIMLDWDPKGKQGPMTPLPDVVTIHMPKEEEEFAHKPHVGKEAEM

SEQ ID NO: 1335 - DNA, 783 bp, Musa acuminata
  misc_feature: Ceres Clone ID no. 1728202
  misc_feature: Encodes the peptide sequence at SEQ ID NO. 1336
gtctagggtttcacagagaaccaacaccgctacaccatacgaagagcggcggcgagttcgttccccctcgaataacctccgagatggcaacccagatgagtaagaagcgaaagtttgtggcggatggggtgttcttcgcggagttgaacgaggtgctaacgagagagttggcggaggatggctattcgggtgtggaggttagggttacgcccatgcggaccgagatcattattcgggcgacgcgcacacagaacgtccttggtgagaagggaagaaggatcagggaattgacatcggtggtgcagaaaagattcaactttccggagaatggcgttgagctctacgccgagaaggtgaacaatagggggctctgtgccattgctcaggctgaatcgctccgttacaagcttcttggcggccttgccgttaggagggcctgttatggtgttctgaggtttgtcatggagagtggtgcaaaggggtgtgaggtaattgtaagcggaaagctcagggctcagcgtgccaagtccatgaagttcaaggatgggtatatgatttcttctggtcagccggtcaatgaatatattgactctgcagtgaggcatattctcctaagacagggtgttcttggaatcaaggtcaaaattatgttggattgggatccaaagggaaagcaaggtcctactacgcctctgccagatctcgtcaccattcatccaccaaaggacgaagatgaatatgtcaggccaacaccaactttggctccagaggtagccatcgtct

SEQ ID NO: 1336 - protein, 233 aa, Musa acuminata
  misc_feature: Ceres Clone ID no. 1728202
  misc_feature (1)..(233): Bit score of 488.9 for hmm based on sequences of FIGURE 16.
  misc_feature (45)..(102): Pfam Name: KH_2 Pfam Description: KH domain
  misc_feature: Functional Homolog Of SEQ ID NO. 1311
MATQMSKKRKFVADGVFFAELNEVLTRELAEDGYSGVEVRVTPMRTEIIIRATRTQNVLGEKGRRIRELTSVVQKRFNFPENGVELYAEKVNNRGLCAIAQAESLRYKLLGGLAVRRACYGVLRFVMESGAKGCEVIVSGKLRAQRAKSMKFKDGYMISSGQPVNEYIDSAVRHILLRQGVLGIKVKIMLDWDPKGKQGPTTPLPDLVTIHPPKDEDEYVRPTPTLAPEVAIV

SEQ ID NO: 1337 - DNA, 694 bp, Panicum virgatum
  misc_feature: Ceres Clone ID no. 1994239
  misc_feature: Encodes the peptide sequence at SEQ ID NO. 1338
ctctcgcgccgccactcccctcccgttccgctcgcccaaaaccctagcgctccccaccgccgcagcgagcgcctcctctccctccgtcaaccatggcgacccagatcagcaagaagaagaagttcgtcagcgatggtgtgttctacgcggagctgaacgagatgctgacgcgggagctcgcggaggatggctactccggcgtggaggtgcgcgtcaccccgatgcgcacggagatcatcatccgcgccacgcgcacccagaacgtgctcggcgagaagggccgcaggatcagggagctcacctccgtagtccagaagcggttcaacttccccgagaacggcgtcgagctctacgccgagaaggtcgtcaaccgcggcctctgcgccatcgcccaggccgagtccctccgctacaagctccttggaggcctcgccgtccgcagggcttgctatggtgttcttcgctttgttatggagagtggtgccaagggttgtgaggtcattgtgagtggaaagctcagggcccaaagagccaagtccatgaagttcaaggatggctacatgatctcatctggtcagcctgtgaacgagtacattgactctgctgtcagacacgtccttctcagacagggtgttcttggcatcaaagttaagatcatgctcgactgggacccgaagggcaagcttggcccggt

SEQ ID NO: 1338 - protein, 200 aa, Panicum virgatum
  misc_feature: Ceres Clone ID no. 1994239
  misc_feature (1)..(200): Bit score of 488.5 for hmm based on sequences of FIGURE 16.
  misc_feature (45)..(102): Pfam Name: KH_2 Pfam Description: KH domain
  misc_feature: Functional Homolog Of SEQ ID NO. 1311
MATQISKKKKFVSDGVFYAELNEMLTRELAEDGYSGVEVRVTPMRTEIIIRATRTQNVLGEKGRRIRELTSVVQKRFNFPENGVELYAEKVVNRGLCAIAQAESLRYKLLGGLAVRRACYGVLRFVMESGAKGCEVIVSGKLRAQRAKSMKFKDGYMISSGQPVNEYIDSAVRHVLLRQGVLGIKVKIMLDWDPKGKLGP

SEQ ID NO: 1339 - DNA, 685 bp, Miscanthus x giganteus
  misc_feature: Ceres Clone ID no. 2055551
  misc_feature: Encodes the peptide sequence at SEQ ID NO. 1340
gccgccactcccctaccgacccactcgcccaaaaccctagcgctcttgcccgctcgccgccgccgccggagcgggctccccatcttcctcagtcaaccatggcgacccagatcagcaagaagaagaagttcgtcagcgacggtgtgttctacgccgagctcaacgagatgctgacgcgggagctggcggaggacggctactccggcgtggaggtgcgcgtcacgccgatgcgcacggagatcatcatccgcgccacgcgcacgcagaatgtgcttggcgagaagggccgcaggatcagggagctcacctccgtcgtccagaagaggttcaacttccccgagaacggcgtcgagctctacgccgagaaggtcgtcaaccgcggcctctgcgccatcgcgcaggctgagtccctccgctacaagctcctcggaggccttgccgtccggagggcttgctatggtgttcttcgctttgttatggagagtggtgccaagggttgtgaggttattgtgagtggaaagctcagggcccaaagagccaagtccatgaaattcaaggatggctacatgatctcatctggtcagccagttaacgagtacattgacgcagctgtgagacacgtccttctcagacagggtgttctgggtatcaaggtgaagatcatgctcgactgggacccgaaagg

SEQ ID NO: 1340 - protein, 195 aa, Miscanthus x giganteus
  misc_feature: Ceres Clone ID no. 2055551
  misc_feature (1)..(195): Bit score of 488.5 for hmm based on sequences of FIGURE 16.
  misc_feature (45)..(102): Pfam Name: KH_2 Pfam Description: KH domain
  misc_feature: Functional Homolog Of SEQ ID NO. 1311
MATQISKKKKFVSDGVFYAELNEMLTRELAEDGYSGVEVRVTPMRTEIIIRATRTQNVLGEKGRRIRELTSVVQKRFNFPENGVELYAEKVVNRGLCAIAQAESLRYKLLGGLAVRRACYGVLRFVMESGAKGCEVIVSGKLRAQRAKSMKFKDGYMISSGQPVNEYIDAAVRHVLLRQGVLGIKVKIMLDWDPK

SEQ ID NO: 1341 - DNA, 687 bp, Sorghum bicolor
  misc_feature: Ceres Annot ID no. 8704704
  misc_feature: Encodes the peptide sequence at SEQ ID NO. 1342
atggcgacccagatcagcaagaagaagaagttcgtcagcgacggtgtgttctacgccgagcttaacgagatgctgacgcgggagctggccgaggacggctactccggcgtggaggtgcgcgtcacgccgatgcgcacggagatcatcatccgcgccacgcgcacgcagaacgtgctcggtgagaagggtcgcaggatcagggagctgacctctgtcgtccagaagaggttcaacttccccgagaacggcgtcgagctctacgccgagaaggtcgtcaaccgcggcctctgcgccatcgcgcaggctgagtccctccgctacaagctcctcggaggccttgccgtccggagggcttgctatggtgttcttcgcttcgttatggagagtggtgctaagggttgtgaggtcattgtcagtggaaagctcagggcccaaagagccaagtccatgaaattcaaggatggctacatgatctcatctggtcagccagtgaatgagtacattgattcggctgtgagacacgtccttctcagacagggtgttcttggtatcaaggtgaagatcatgctcgactgggacccgaagggcaaggttggtccaatcacccctcttccggacctggtgaccatccataccccgaaggacgaggatgagctgcgccctccggtcttggcacctgaggtctaa

SEQ ID NO: 1342 - protein, 228 aa, Sorghum bicolor
  misc_feature: Ceres Annot ID no. 8704704
  misc_feature (1)..(228): Bit score of 488.5 for hmm based on sequences of FIGURE 16.
  misc_feature (45)..(102): Pfam Name: KH_2 Pfam Description: KH domain
  misc_feature: Functional Homolog Of SEQ ID NO. 1311
MATQISKKKKFVSDGVFYAELNEMLTRELAEDGYSGVEVRVTPMRTEIIIRATRTQNVLGEKGRRIRELTSVVQKRFNFPENGVELYAEKVVNRGLCAIAQAESLRYKLLGGLAVRRACYGVLRFVMESGAKGCEVIVSGKLRAQRAKSMKFKDGYMISSGQPVNEYIDSAVRHVLLRQGVLGIKVKIMLDWDPKGKVGPITPLPDLVTIHTPKDEDELRPPVLAPEV

SEQ ID NO: 1343 - protein, 228 aa, Oryza sativa subsp. japonica
  misc_feature: Public GI ID no. 115453877
  misc_feature (1)..(228): Bit score of 488.5 for hmm based on sequences of FIGURE 16.
  misc_feature (45)..(102): Pfam Name: KH_2 Pfam Description: KH domain
  misc_feature: Functional Homolog Of SEQ ID NO. 1311
MATQISKKKKFVSDGVFYAELNEMLTRELAEDGYSGVEVRVTPMRTEIIIRATRTQNVLGEKGRRIRELTSVVQKRFNFPENGVELYAEKVVNRGLCAIAQAESLRYKLLGGLAVRRACYGVLRFVMESGAKGCEVIVSGKLRAQRAKSMKFKDGYMISSGQPVNEYIDSAVRHVLLRQGVLGIKVKIMLDWDPKGKVGPTTPLPDLVTIHAPKEEEELRPPVLIAEA

SEQ ID NO: 1344 - DNA, 674 bp, Glycine max
  misc_feature: Ceres Clone ID no. 1646411
  misc_feature: Encodes the peptide sequence at SEQ ID NO. 1345
agttgctttgtttcactcacactgtgtttggagcagaatcagatcgtgtgttccgtacgttcgttcgttcatttccagtgtcaaacatggcgtctcagatgagcaagaagagaaagtttgttgcggacggagtgttcttcgccgaactgaacgaggttctgacacgtgaattggcggaggacggttactccggcgtggaagttagggttacgccgatgcgcaccgagatcatcatcagagccaccagaacccaggctgttctaggtgagaagggaaggagaattagggaacttacctcagtggtgcagaagaggttcaaattccccgaaaacagtgtcgagctttatgctgagaaggtcaacaacagaggcttgtgtgccattgctcaggccgagtcgcttcgctacaagctcctcggcggcctcgctgttcgcagggcttgctatggtgttttaagatttgtgatggaaagcggtgccaaaggatgcgaggtcattgttagtggaaaactgagagctcagagagccaagtccatgaaattcaaggatggatatatgatttcttctggacaaccagtcaaggattacattgactctgcagtgagacatgtgctactaagacagggtgttcttggtatcaaggttaagatcatgctttgattgggatcctaaagg

SEQ ID NO: 1345 - protein, 190 aa, Glycine max
  misc_feature: Ceres Clone ID no. 1646411
  misc_feature (1)..(190): Bit score of 482.9 for hmm based on sequences of FIGURE 16.
  misc_feature (45)..(102): Pfam Name: KH_2 Pfam Description: KH domain
  misc_feature: Functional Homolog Of SEQ ID NO. 1311
MASQMSKKRKFVADGVFFAELNEVLTRELAEDGYSGVEVRVTPMRTEIIIRATRTQAVLGEKGRRIRELTSVVQKRFKFPENSVELYAEKVNNRGLCAIAQAESLRYKLLGGLAVRRACYGVLRFVMESGAKGCEVIVSGKLRAQRAKSMKFKDGYMISSGQPVKDYIDSAVRHVLLRQGVLGIKVKIML

SEQ ID NO: 1346 - DNA, 591 bp, Zea mays
  misc_feature: Ceres Clone ID no. 100045499
  misc_feature: Encodes the peptide sequence at SEQ ID NO. 1347
caacccactagctcaaaaccctagagctctcgcctgctcgcctccgccgccggagcgagctccccatcttcatccgtcaaccatggcgacccagatcagcaagaagaagaagttcgtcagcgacggtgttttctacgccgagctcaatgagatgctgacgcgggagctggcggaggacggctactctggcgtggaggtgcgcgtcacgccgatgcgcacggagatcatcatccgcgccacgcgcacgcagaacgtgctcggcgagaagggccgtaggatcagggagctcacctccgtcgtccagaagaggttcaacttccctgagaatggcgttgagctttatgccgagaaggtcgtcaaccgtgggctctgtgccatcgcgcaggccgagtccctccgttacaagctcctcggtggccttgccgtccgcagggcttgctacggtgttcttcgttatgttatggagagtggtgccaagggttgtgaggtgatcgtgagtggaaagctcagggcccaaagagccaagtccatgaagttcaaggatggctacatgatctcatctggtcagccagtgaacgagtacattgactc

SEQ ID NO: 1347 - protein, 169 aa, Zea mays
  misc_feature: Ceres Clone ID no. 100045499
  misc_feature (1)..(169): Bit score of 487.2 for hmm based on sequences of FIGURE 16.
  misc_feature (45)..(102): Pfam Name: KH_2 Pfam Description: KH domain
  misc_feature: Functional Homolog Of SEQ ID NO. 1311
MATQISKKKKFVSDGVFYAELNEMLTRELAEDGYSGVEVRVTPMRTEIIIRATRTQNVLGEKGRRIRELTSVVQKRFNFPENGVELYAEKVVNRGLCAIAQAESLRYKLLGGLAVRRACYGVLRYVMESGAKGCEVIVSGKLRAQRAKSMKFKDGYMISSGQPVNEYID

SEQ ID NO: 1348 - DNA, 933 bp, Zea mays
  misc_feature: Ceres Clone ID no. 100920260
  misc_feature: Encodes the peptide sequence at SEQ ID NO. 1349
ctcgcctccgccgccggagcgagctccccatcttcatccgtcaaccatggcgacccagatcagcaagaagaagaagttcgtcagcgacggtgttttctacgccgagctcaatgagatgctgacgcgggagctggcggaggacggctactctggcgtggaggtgcgcgtcacgccgatgcgcacggagatcatcatccgcgccacgcgcacgcagaacgtgctcggcgagaagggccgtaggatcagggagctcacctccgtcgtccagaagaggttcaacttccctgagaatggcgttgagctttatgccgagaaggtcgtcaaccgtgggctctgtgccatcgcgcaggccgagtccctccgttacaagctcctcggtggccttgccgtccgcagggcttgctacggtgttcttcgttatgttatggagagtggtgccaagggttgtgaggtgatcgtgagtggaaagctcagggcccaaagagccaagtccatgaagttcaaggakggctacatgatytcwtytggtcagccagtgaacgagtacattgaytcggctgtgagacacgttyttytcagacagggtgttyttggcatcaaggtgaagatcatgcttgactgggacccgaagggcaaggttggcccgatcactcytyttccggacctggkgmccatccmcmccccgaaggasgaggacgagccgcgccctccggtcttggcmcctcctgaggkgtaaggtcccaactgtgtccttgaaatggcagtttgatcgggtcctagataggttttttttttacgataaggacaatgttaaggcagttggttcccttaatctttatggacagatgctatgtgttgcttttgtggcacttttgtttaagttaagttttggggagccaagatacttatatatgttcccgaggaaattagggt

SEQ ID NO: 1349 - protein, 229 aa, Zea mays
  misc_feature: Ceres Clone ID no. 100920260
  misc_feature (1)..(229): Bit score of 469.9 for hmm based on sequences of FIGURE 16.
  misc_feature (45)..(102): Pfam Name: KH_2 Pfam Description: KH domain
  misc_feature: Functional Homolog Of SEQ ID NO. 1311
  misc_feature (154)..(154): Xaa is any aa, unknown, or other
  misc_feature (158)..(158): Xaa is any aa, unknown, or other
  misc_feature (159)..(159): Xaa is any aa, unknown, or other
  misc_feature (160)..(160): Xaa is any aa, unknown, or other
  misc_feature (169)..(169): Xaa is any aa, unknown, or other
  misc_feature (176)..(176): Xaa is any aa, unknown, or other
  misc_feature (177)..(177): Xaa is any aa, unknown, or other
  misc_feature (182)..(182): Xaa is any aa, unknown, or other
  misc_feature (203)..(203): Xaa is any aa, unknown, or other
  misc_feature (204)..(204): Xaa is any aa, unknown, or other
  misc_feature (208)..(208): Xaa is any aa, unknown, or other
  misc_feature (209)..(209): Xaa is any aa, unknown, or other
  misc_feature (211)..(211): Xaa is any aa, unknown, or other
  misc_feature (212)..(212): Xaa is any aa, unknown, or other
  misc_feature (215)..(215): Xaa is any aa, unknown, or other
  misc_feature (225)..(225): Xaa is any aa, unknown, or other
  misc_feature (229)..(229): Xaa is any aa, unknown, or other
MATQISKKKKFVSDGVFYAELNEMLTRELAEDGYSGVEVRVTPMRTEIIIRATRTQNVLGEKGRRIRELTSVVQKRFNFPENGVELYAEKVVNRGLCAIAQAESLRYKLLGGLAVRRACYGVLRYVMESGAKGCEVIVSGKLRAQRAKSMKFKXGYMXXXGQPVNEYIXSAVRHVXXRQGVXGIKVKIMLDWDPKGKVGPITXXPDLXXIXXPKXEDEPRPPVLXPPEX

SEQ ID NO: 1350 - protein, 233 aa, Picea sitchensis
  misc_feature: Public GI ID no. 116786147
  misc_feature (1)..(233): Bit score of 484.3 for hmm based on sequences of FIGURE 16.
  misc_feature (45)..(102): Pfam Name: KH_2 Pfam Description: KH domain
  misc_feature: Functional Homolog Of SEQ ID NO. 1311
MATQMSKKKKFVADGVFFAELNEVLTRELAEDGYSGVEVRVTPMRTEIIIRATRTQNVLGEKGRRIRELTSVVQKRFNFPEGTVELYAEKVNNRGLCAIAQAESLRYKLLGGLAVRRACYGVLRFIMESGAKGCEVIVSGKLRAQRAKSMKFKDGYMISSGQPVNEYIDKAVRHVLLRQGVLGIKVKIMLDWDPKGKQGPTTPLPDLVTIHTPKEEEEFAAKPQLGKETEILV

SEQ ID NO: 1351 - protein, 233 aa, Picea sitchensis
  misc_feature: Public GI ID no. 116783944
  misc_feature (1)..(233): Bit score of 481.8 for hmm based on sequences of FIGURE 16.
  misc_feature (45)..(102): Pfam Name: KH_2 Pfam Description: KH domain
  misc_feature: Functional Homolog Of SEQ ID NO. 1311
MAKQMSKKRKFVADGVFFAELNEVLTRELAEDGYSGVEVRVTPMRTEIIIRATRTQNVLGEKGRRIRELTSVVQKRFNFPEGTVELYAEKVNNRGLCAIAQAESLRYKLLGGLAVRRACYGVLRFIMESGAKGCEVIVSGKLRAQRAKSMKFKDGYMISSGQPVNEYIDRAVRHVLLRQGVLGIKVKIMLDWDPKGKQGPTKPLPDFVTIYTPKDEEDFSSKPSVGNEVEILA

SEQ ID NO: 1352 - DNA, 608 bp, Glycine max
  misc_feature: Ceres Clone ID no. 1465853
  misc_feature: Encodes the peptide sequence at SEQ ID NO. 1353
tagcgccacactccaatcgtagccgtcgcactctgtgttttctgcgccgtctccgatctccgacaatggcgacccaaatgagcaagaagagaaagttcgtagctgatggagtgttcttcgctgaactgaacgaggttctgacaagagagttggccgaggacggttactccggcgtggaagttagggttacgccgatgcgcaccgaaatcataattagagccaccagaacccaagctgttctcggtgagaagggaaggagaataagggaacttacctctgtggttcagaagaggttcaagtttcccgagaacagtgttgaactttatgctgaaaaggtcaaccataggggtctttgcgctattgctcaggctgagtctcttcgctacaagctccttggtggactcgctgtgcgcatggcctgctatggtgttttgaggtttgttatggagagtggtgctaagggatgcgaggtcattgtgagtggaaaattgagagcccagagagccaaatctatgaagtttaaggatgggtacatgatttcttctgggcaacctgtcaaagattacattgactctgcagtgagacatgtgctcctgagacagggtgtt

SEQ ID NO: 1353 - protein, 181 aa, Glycine max
  misc_feature: Ceres Clone ID no. 1465853
  misc_feature (1)..(181): Bit score of 484.1 for hmm based on sequences of FIGURE 16.
  misc_feature (45)..(102): Pfam Name: KH_2 Pfam Description: KH domain
  misc_feature: Functional Homolog Of SEQ ID NO. 1311
MATQMSKKRKFVADGVFFAELNEVLTRELAEDGYSGVEVRVTPMRTEIIIRATRTQAVLGEKGRRIRELTSVVQKRFKFPENSVELYAEKVNHRGLCAIAQAESLRYKLLGGLAVRMACYGVLRFVMESGAKGCEVIVSGKLRAQRAKSMKFKDGYMISSGQPVKDYIDSAVRHVLLRQGV

SEQ ID NO: 1354 - protein, 238 aa, Solanum tuberosum
  misc_feature: Public GI ID no. 82623397
  misc_feature (1)..(238): Bit score of 480.7 for hmm based on sequences of FIGURE 16.
  misc_feature (46)..(103): Pfam Name: KH_2 Pfam Description: KH domain
  misc_feature: Functional Homolog Of SEQ ID NO. 1311
MATPQISKKRKFVADGVFFAELNEVLTRELAEDGYSGVEVRVTPMRTEIIIRATRTQNVLGEKGRRIRELTSVVQKRFNFKENSVELYAEKVNNRGLCAIAQAESLRYKLLGGLAVRRACYGVLRFVMESGAKGCEVIVSGKLRAQRAKSMKFKDGYMISSGQPVKEYIDAAVRHVLLRQGVLGIKVKIMLDWDPKGKQGPMTPLPDLVTIHPPKEEGEFVVPPPIIAAPAIEVLPVA

SEQ ID NO: 1355 - DNA, 699 bp, Sorghum bicolor
  misc_feature: Ceres Annot ID no. 8656662
  misc_feature: Encodes the peptide sequence at SEQ ID NO. 1356
atggcgtcgactcatgcaatcagcaagaagcggaagttcgtggcggatggcgtgttcttcgcggagctgaatgagatgctcacccgcgagctcgcggaggatggctactccggcgtcgaggtccgcgtcacccccatgcgcaccgagatcatcatccgtgccactcgcacccagaacgtcctcggcgagaagggccggagaatcagggagctgacttctgtggttcagaagcgctttaacttcccggagggtggcgttgaactctacgcagagaaggtgaacaaccgtgggctctgcgccatcgcccaggccgagtcgcttcgctacaagcttctgggtggactagccgtgagaagggcatgttatggtgttctcaggtttgtcatggagagtggcgctaagggctgtgaggttattgtaagtggcaagctcagagcccagcgtgctaagtctatgaagttcaaggatgggtacatgatttcttctggtcatcctgtgaacctatatattgattcagctgtgagacatgttctcttgagacagggtgtgcttggtatcaaggttaagattatgcttgactgggatccaaagggcaagcaagggccaaccatgcctttacctgatctggttacaatccacgagcctaaggaagaggatgagtttttgaggcctcttgcagccgaaatcccagttgcctga

SEQ ID NO: 1356 - protein, 232 aa, Sorghum bicolor
  misc_feature: Ceres Annot ID no. 8656662
  misc_feature (1)..(232): Bit score of 473.6 for hmm based on sequences of FIGURE 16.
  misc_feature (47)..(104): Pfam Name: KH_2 Pfam Description: KH domain
  misc_feature: Functional Homolog Of SEQ ID NO. 1311
MASTHAISKKRKFVADGVFFAELNEMLTRELAEDGYSGVEVRVTPMRTEIIIRATRTQNVLGEKGRRIRELTSVVQKRFNFPEGGVELYAEKVNNRGLCAIAQAESLRYKLLGGLAVRRACYGVLRFVMESGAKGCEVIVSGKLRAQRAKSMKFKDGYMISSGHPVNLYIDSAVRHVLLRQGVLGIKVKIMLDWDPKGKQGPTMPLPDLVTIHEPKEEDEFLRPLAAEIPVA

SEQ ID NO: 1357 - DNA, 609 bp, Triticum aestivum
  misc_feature: Ceres Clone ID no. 1417803
  misc_feature: Encodes the peptide sequence at SEQ ID NO. 1358
atccaaacctagggtttaccttctgccgccgccgccaaatcatctccctccccctcccttctccaacatggctcttcagatcagcaagaagcgaaagttcgtcgccgacggcgtgtttctggccgagctgaacgagatgctgacccgcgagctcggggaggacggcttcgccggcgtcgagatccgggtcacccccatgcgcaccgagatcatcatccgcgccacccgcactcagaacgtcctcggcgagaagggccggaggataagggagctgacgtcggtggtgcagaagcgcttcaactttccggacggcggcgtcgagctgtacgccgagaaggtcctgaaccgcggcctctgcgccgtcgctcaggccgagtccctccgctacaagctgctcggtggcctcgccgtccgaagagcgtgctatggtgtactccgatttgtcatggagagtggtgcgaagggctgcgaggttattgtgagtgggaagcttagggcacagcgtgctaagtccatgaagttcaaggatggctatatgatctcttctggccatcctgtcaacagtatattgatggagctgtgaggcatgttcttctgagacagggtgtg

SEQ ID NO: 1358 - protein, 171 aa, Triticum aestivum
  misc_feature: Ceres Clone ID no. 1417803
  misc_feature (1)..(171): Bit score of 466.5 for hmm based on sequences of FIGURE 16.
  misc_feature (45)..(102): Pfam Name: KH_2 Pfam Description: KH domain
  misc_feature: Functional Homolog Of SEQ ID NO. 1311
MALQISKKRKFVADGVFLAELNEMLTRELGEDGFAGVEIRVTPMRTEIIIRATRTQNVLGEKGRRIRELTSVVQKRFNFPDGGVELYAEKVLNRGLCAVAQAESLRYKLLGGLAVRRACYGVLRFVMESGAKGCEVIVSGKLRAQRAKSMKFKDGYMISSGHPVNSILMEL

SEQ ID NO: 1359 - DNA, 516 bp, Triticum aestivum
  misc_feature: Ceres Clone ID no. 753982
  misc_feature: Encodes the peptide sequence at SEQ ID NO. 1360
atccaaacctagggtttaccttctgccgccgccgccaaatcatctccctccccctcccttctccaacatggctcttcagatcagcaagaagcgaaagttcgtcgccgacggcgtgtttctggccgagctgaacgagatgctgacccgcgagctcggggaggacggcttcgccggcgtcgagatccgggtcacccccatgcgcaccgagatcatcatccgcgccacccgcactcagaacgtcctcggcgagaagggccggaggataagggagctgacgtcggtggtgcagaagcgcttcaactttccggacggcggcgtcgagctgtacgccgagaaggtcctgaaccgcggcctctgcgccgtcgctcaggccgagtccctccgctacaagctgctcggtggcctcgccgtccgaagagcgtgctatggtgtactccgatttgtcatggagagtggtgcgaagggctgcgaggttatygtgagtgggaagcttagggcacagcgtgctaagtccat

SEQ ID NO: 1360 - protein, 149 aa, Triticum aestivum
  misc_feature: Ceres Clone ID no. 753982
  misc_feature (1)..(149): Bit score of 385.8 for hmm based on sequences of FIGURE 16.
  misc_feature (45)..(102): Pfam Name: KH_2 Pfam Description: KH domain
  misc_feature: Functional Homolog Of SEQ ID NO. 1311
  misc_feature (137)..(137): Xaa is any aa, unknown, or other
MALQISKKRKFVADGVFLAELNEMLTRELGEDGFAGVEIRVTPMRTEIIIRATRTQNVLGEKGRRIRELTSVVQKRFNFPDGGVELYAEKVLNRGLCAVAQAESLRYKLLGGLAVRRACYGVLRFVMESGAKGCEVXVSGKLRAQRAKS

SEQ ID NO: 1361 - protein, 231 aa, Ostreococcus lucimarinus CCE9901
  misc_feature: Public GI ID no. 145345927
  misc_feature (1)..(231): Bit score of 414.3 for hmm based on sequences of FIGURE 16.
  misc_feature (46)..(103): Pfam Name: KH_2 Pfam Description: KH domain
  misc_feature: Functional Homolog Of SEQ ID NO. 1311
MVATAISKKRKFVADGVFFAELNEMLVRELAEDGYSGVEVRQTPMRTEIIIRATRTANVLGEKGRRIRELTTLVQRRFQMAEGSVELYAERVNNRGLCAIAQCESLRYKLLGGLAVRRACYGVLRYIMEAGAKGAEVVVSGKLRGQRAKAMKFKDGYMISSGNPVREYIVSCTRHALLRQGTIGMRVKIMLDHDPKGRNGPSTPIPDTVVIHTPKDDEDMAKPYVGKEMEM

SEQ ID NO: 1362 - DNA, 985 bp, Arabidopsis thaliana
  misc_feature: Ceres Seedline no. ME04246
  misc_feature: Encodes the peptide sequence at SEQ ID NO. 1311
taacgcactctcttctccgaatctagggtttttgtctctagcctcctcaagctttgcaaacaatcatggcgacccagatcagcaagaagagaaagttcgtagccgatggtgtgttttacgctgaactcaatgaggttctaaccagagagcttgctgaggatggttactctggtgttgaggttcgcgtcactcctatgcgtactgagatcatcattagagccactcgtactcaaaacgttctcggtgagaagggaaggaggattagggaattgacatctcttgtacaaaagagattcaaatttcctcaggacagtgttgagctttatgctgagaaggttgctaacagaggtctttgtgctattgctcaggctgagtctcttcgttacaagcttcttggtggtcttgctgttcgtagggcgtgctatggtgttttaaggtttgttatggagagtggagctaaaggatgcgaagtcattgtgagtggaaaactccgtgctgcacgtgctaagtagatgaagttcaaggatggttacatggtttcctcaggtcagccaaccaaggaatacattgatgctgcagttaggcatgttcttcttagacagggtgtgcttggtctcaaggtgaagatcatgcttgactgggaccccaagggcaaacaaggaccgatgacaccattgcctgatgttgtgatcatccatacaccgaaagaagatgatgtatacattgcacctgctcaggttgttactcaagctgcttttgtaccggaagctccattaaccaccacagattatccagcaatgccagttgcttagagagccttttcgttttctggtttaaaacccaatggggatggttctttttttgggacagtactagttttctcatgttattctaagttaatacttaaagttctggaggttgaattacatcaaggatatgaatgtatgtttttcgttatcttttgtttaaattttatttatctatt

SEQ ID NO: 1363 - protein, 36 aa, Artificial Sequence
  consensus sequence for the AN1-like zinc finger domain/ DnaJ domain
  misc_feature (2)..(2): Xaa is any aa, unknown, or other
  misc_feature (3)..(3): Xaa is any aa, unknown, or other
  misc_feature (5)..(5): Xaa is any aa, unknown, or other
  misc_feature (6)..(6): Xaa is any aa, unknown, or other
  misc_feature (7)..(7): Xaa is any aa, unknown, or other
  misc_feature (8)..(8): Xaa is any aa, unknown, or other
  misc_feature (9)..(9): Xaa is any aa, unknown, or other
  misc_feature (10)..(10): Xaa is any aa, unknown, or other
  misc_feature (11)..(11): Xaa is any aa, unknown, or other
  misc_feature (12)..(12): Xaa is any aa, unknown, or other
  misc_feature (13)..(13): Xaa is any aa, unknown, or other
  misc_feature (14)..(14): Xaa is any aa, unknown, other, or absent
  misc_feature (15)..(15): Xaa is any aa, unknown, other, or absent
  misc_feature (16)..(16): Xaa is any aa, unknown, other, or absent
  misc_feature (18)..(18): Xaa is any aa, unknown, or other
  misc_feature (19)..(19): Xaa is any aa, unknown, other, or absent
  misc_feature (21)..(21): Xaa is any aa, unknown, or other
  misc_feature (22)..(22): Xaa is any aa, unknown, or other
  misc_feature (23)..(23): Xaa is any aa, unknown, or other
  misc_feature (24)..(24): Xaa is any aa, unknown, or other
  misc_feature (26)..(26): Xaa is any aa, unknown, or other
  misc_feature (27)..(27): Xaa is any aa, unknown, or other
  misc_feature (29)..(29): Xaa is any aa, unknown, or other
  misc_feature (30)..(30): Xaa is any aa, unknown, or other
  misc_feature (31)..(31): Xaa is any aa, unknown, or other
  misc_feature (32)..(32): Xaa is any aa, unknown, or other
  misc_feature (33)..(33): Xaa is any aa, unknown, or other
  misc_feature (35)..(35): Xaa is any aa, unknown, or other
CXXCXXXXXXXXXXXXCXXCXXXXCXXHXXXXXHXC

SEQ ID NO: 1364 - protein, 8 aa, Artificial Sequence
  consensus sequence for the AN1-like zinc finger domain/ DnaJ domain
  misc_feature (2)..(2): Xaa is any aa, unknown, or other
  misc_feature (3)..(3): Xaa is any aa, unknown, or other
  misc_feature (5)..(5): Xaa is any aa, unknown, or other
  misc_feature (7)..(7): Xaa is any aa, unknown, or other
CXXCXGXG

What is claimed is:

1. A method of producing a plant, said method comprising:

growing a plant comprising an exogenous nucleic acid, said exogenous nucleic acid comprising a regulatory region operably linked to a nucleotide sequence encoding a polypeptide having 95 percent or greater sequence identity to the amino acid sequence set forth in SEQ ID NO: 749;

applying limited water conditions for at least two weeks; and selecting for a plant having increased chronic drought tolerance compared to a control plant that does not comprise said nucleic acid.

2. A method of increasing chronic drought tolerance in a plant, said method comprising:
introducing into a plant cell an exogenous nucleic acid, said exogenous nucleic acid comprising a regulatory region operably linked to a nucleotide sequence encoding a polypeptide having 95 percent or greater sequence identity to the amino acid sequence set forth in SEQ ID NO: 749;
growing the plant cell comprising the exogenous nucleic acid to generate a plant comprising the exogenous nucleic acid;
applying limited water conditions to said plant for at least two weeks;
and selecting for a plant that has an increase in chronic drought tolerance compared to a control plant that does not comprise said nucleic acid.

3. The method of claim 1, wherein said plant having increased chronic drought tolerance further exhibits increased plant growth under limited water conditions.

4. The method of claim 3, wherein said increased plant growth comprises increased plant height.

5. The method of claim 2, wherein said increased chronic drought tolerance comprises an increase in plant growth under limited water conditions.

6. The method of claim 5, wherein said increased plant growth comprises increased plant height.

7. The method of claim 1, further comprising: growing the plant having increased chronic drought tolerance and producing seed from the plant.

8. The method of claim 1, further comprising: crossing the plant having increased chronic drought tolerance with itself to produce seed comprising the exogenous nucleic acid; and growing progeny plants from said seed.

9. The method of claim 2, further comprising: crossing the plant having increased chronic drought tolerance with itself to produce seed comprising the exogenous nucleic acid; and growing progeny plants from said seed.

10. The method of claim 1, wherein said polypeptide has 97 percent or greater sequence identity to the amino acid sequence set forth in SEQ ID NO:749.

11. The method of claim 1, wherein said polypeptide comprises the amino acid sequence set forth in SEQ ID NO:749.

12. The method of claim 2, wherein said polypeptide has 97 percent or greater sequence identity to the amino acid sequence set forth in SEQ ID NO:749.

13. The method of claim 2, wherein said polypeptide comprises the amino acid sequence set forth in SEQ ID NO:749.

* * * * *